US010607717B2

(12) United States Patent
Staudt et al.

(10) Patent No.: US 10,607,717 B2
(45) Date of Patent: Mar. 31, 2020

(54) METHOD FOR SUBTYPING LYMPHOMA TYPES BY MEANS OF EXPRESSION PROFILING

(71) Applicants: The United States of America, as represented by the Secretary, Department of Health and Human Services, Bethesda, MD (US); British Columbia Cancer Agency Branch, Vancouver (CA); Arizona Board of Regents on Behalf of the University of Arizona, Tucson, AZ (US); Universitat de Barcelona, Barcelona (ES); Hospital Clinic de Barcelona, Barcelona (ES); The Cleveland Clinic Foundation, Cleveland, OH (US); The Board of Regents of the University of Nebraska, Lincoln, NE (US); Oregon Health and Science University, Portland, OR (US); Julius-Maximilians-University of Würzburg, Würzburg (DE); Oslo University Hospital HF, Oslo (NO)

(72) Inventors: Louis M. Staudt, Bethesda, MD (US); George W. Wright, Rockville, MD (US); David William Scott, Vancouver (CA); Joseph M. Connors, Vancouver (CA); Randy D. Gascoyne, North Vancouver (CA); Lisa Rimsza, Scottsdale, AZ (US); Elias Campo Guerri, Barcelona (ES); Raymond Tubbs, Cleveland, OH (US); Timothy C. Greiner, Council Bluffs, IA (US); James Robert Cook, Shaker Heights, OH (US); Kai Fu, Omaha, NE (US); Paul Michael Williams, Great Falls, VA (US); Chih-Jian Lih, Gaithersburg, MD (US); Elaine S. Jaffe, Great Falls, VA (US); Rita M. Braziel, West Linn, OR (US); Andreas Rosenwald, Wuerzburg (DE); Erlend B. Smeland, Oslo (NO); Wing C. Chan, Pasadena, CA (US); German Ott, Bietigheim-Bissingen (DE); Jan Delabie, Toronto (CA); Dennis Weisenburger, Glendora, CA (US)

(73) Assignees: The United States of America, as represented by the Secretary, Department of Health and Human Services, Bethesda, MD (US); British Columbia Cancer Agency Branch, Vancouver (CA); Arizona Board of Regents on behalf of the University of Arizona, Tucson, AZ (US); Universitat de Barcelona, Barcelona (ES); Hospital Clinic de Barcelona, Barcelona (ES); The Cleveland Clinic Foundation, Cleveland, OH (US); Board of Regents of the University of Nebraska, Lincoln, NE (US); Oregon Health and Science University, Portland, OR (US); Julius-Maximilians-University of Würzburg, Würzburg (DE); Oslo University Hospital HF, Oslo (NO)

( * ) Notice: Subject to any disclaimer, the term of this patent is extended or adjusted under 35 U.S.C. 154(b) by 696 days.

(21) Appl. No.: 15/035,101

(22) PCT Filed: Nov. 5, 2014

(86) PCT No.: PCT/US2014/064161
§ 371 (c)(1),
(2) Date: May 6, 2016

(87) PCT Pub. No.: WO2015/069790
PCT Pub. Date: May 14, 2015

(65) Prior Publication Data
US 2016/0283653 A1    Sep. 29, 2016

Related U.S. Application Data

(60) Provisional application No. 61/900,553, filed on Nov. 6, 2013.

(51) Int. Cl.
*G01N 33/48*    (2006.01)
*G16B 25/00*    (2019.01)
(Continued)

(52) U.S. Cl.
CPC ........... *G16B 25/00* (2019.02); *C12Q 1/6886* (2013.01); *G16B 5/00* (2019.02);
(Continued)

(58) Field of Classification Search
None
See application file for complete search history.

(56) References Cited

U.S. PATENT DOCUMENTS 5,143,854 A    9/1992    Pirrung et al.
5,242,974 A    9/1993    Holmes
(Continued)

FOREIGN PATENT DOCUMENTS

JP    2012-533308 A    1/2011
JP    2011-510663 A    4/2011
(Continued)

OTHER PUBLICATIONS

Castillo, et al. "Prognostic factors in chemotherapy-treated patients with HIV-associated plasmablastic lymphoma," The oncologist, vol. 15 (2010) pp. 293-299.*
(Continued)

*Primary Examiner* — Anna Skibinsky
(74) *Attorney, Agent, or Firm* — Leydig, Voit & Mayer, Ltd.

(57) ABSTRACT

The invention is directed to methods for selecting a treatment option for an activated B cell-like diffuse large B cell (Continued)

lymphoma (ABC DLBCL) subject, a germinal center B cell-like diffuse large B cell lymphoma (GCB DLBCL) subject, a primary mediastinal B cell lymphoma (PMBL) subject, a Burkitt lymphoma (BL) subject, or a mantle cell lymphoma (MCL) subject by analyzing digital gene expression data obtained from the subject, e.g., from a biopsy sample.

3 Claims, 1 Drawing Sheet

Specification includes a Sequence Listing.

(51) Int. Cl.
  *G16B 5/00* (2019.01)
  *C12Q 1/6886* (2018.01)
(52) U.S. Cl.
  CPC .. *C12Q 2600/106* (2013.01); *C12Q 2600/112* (2013.01); *C12Q 2600/158* (2013.01)

(56) References Cited

U.S. PATENT DOCUMENTS

| | | | |
|---|---|---|---|
| 5,252,743 A | 10/1993 | Barrett et al. | |
| 5,324,633 A | 6/1994 | Fodor et al. | |
| 5,384,261 A | 1/1995 | Winkler et al. | |
| 5,424,186 A | 6/1995 | Fodor et al. | |
| 5,445,934 A | 8/1995 | Fodor et al. | |
| 5,451,683 A | 9/1995 | Barrett et al. | |
| 5,482,867 A | 1/1996 | Barrett et al. | |
| 5,491,074 A | 2/1996 | Aldwin et al. | |
| 5,527,681 A | 6/1996 | Holmes | |
| 5,550,215 A | 8/1996 | Holmes | |
| 5,571,639 A | 11/1996 | Hubbell et al. | |
| 5,578,832 A | 11/1996 | Trulson et al. | |
| 5,593,839 A | 1/1997 | Hubbell et al. | |
| 5,599,695 A | 2/1997 | Pease et al. | |
| 5,624,711 A | 4/1997 | Sundberg et al. | |
| 5,631,734 A | 5/1997 | Stern et al. | |
| 5,708,153 A | 1/1998 | Dower et al. | |
| 5,744,305 A | 4/1998 | Fodor et al. | |
| 5,770,358 A | 6/1998 | Dower et al. | |
| 5,789,162 A | 8/1998 | Dower et al. | |
| 5,795,716 A | 8/1998 | Chee et al. | |
| 5,800,992 A | 9/1998 | Fodor et al. | |
| 5,831,070 A | 11/1998 | Pease et al. | |
| 5,837,832 A | 11/1998 | Chee et al. | |
| 5,856,101 A | 1/1999 | Hubbell et al. | |
| 5,856,174 A | 1/1999 | Lipshutz et al. | |
| 5,858,659 A | 1/1999 | Sapolsky et al. | |
| 5,922,591 A | 7/1999 | Anderson et al. | |
| 5,936,324 A | 8/1999 | Montagu | |
| 5,968,740 A | 10/1999 | Fodor et al. | |
| 5,974,164 A | 10/1999 | Chee | |
| 5,981,185 A | 11/1999 | Matson et al. | |
| 5,981,956 A | 11/1999 | Stern | |
| 6,020,198 A | 2/2000 | Bennett et al. | |
| 6,025,601 A | 2/2000 | Trulson et al. | |
| 6,033,860 A | 3/2000 | Lockhart et al. | |
| 6,040,193 A | 3/2000 | Winkler et al. | |
| 6,090,555 A | 7/2000 | Fiekowsky et al. | |
| 6,410,229 B1 | 6/2002 | Lockhart et al. | |
| 7,711,492 B2 | 5/2010 | Staudt et al. | |
| 7,919,237 B2 | 4/2011 | Dimitrov et al. | |
| 2002/0110820 A1 | 8/2002 | Ramaswamy et al. | |
| 2003/0104411 A1 | 6/2003 | Fodor et al. | |
| 2003/0194701 A1 | 10/2003 | Golub et al. | |
| 2003/0219760 A1 | 11/2003 | Gordon et al. | |
| 2005/0112630 A1 | 5/2005 | Shaughnessy et al. | |
| 2005/0164231 A1 | 7/2005 | Staudt et al. | |
| 2007/0105136 A1 | 5/2007 | Staudt et al. | |
| 2008/0132504 A1 | 6/2008 | Garcia-Echeverria et al. | |
| 2008/0193462 A1 | 8/2008 | Kung et al. | |
| 2009/0181393 A1 | 7/2009 | Mulligan et al. | |
| 2009/0233279 A1 | 9/2009 | Glinskii | |
| 2009/0253583 A1 | 10/2009 | Yoganathan | |
| 2011/0104671 A1* | 5/2011 | Dornan | C12Q 1/6886 |
| 2011/0152115 A1 | 6/2011 | Staudt et al. | |
| 2011/0195064 A1 | 8/2011 | Rimsza et al. | |
| 2012/0087915 A1* | 4/2012 | Buggy | A61K 31/195 424/133.1 |
| 2012/0225432 A1 | 9/2012 | Campo Guerri et al. | |
| 2012/0258878 A1 | 10/2012 | Saad | |
| 2013/0011409 A1* | 1/2013 | Shipp | C07K 16/18 424/156.1 |
| 2013/0259858 A1 | 10/2013 | Zacksenhaus et al. | |

FOREIGN PATENT DOCUMENTS

| | | |
|---|---|---|
| WO | WO 02/024956 A2 | 3/2002 |
| WO | WO 03/024956 A1 | 3/2003 |
| WO | WO 2005/024043 A2 | 3/2005 |
| WO | WO 2008/013910 A2 | 1/2008 |
| WO | WO 2009/100029 A1 | 8/2009 |
| WO | WO 2009/149359 A2 | 12/2009 |
| WO | WO 2011/009104 A1 | 1/2011 |
| WO | WO 2011/097476 A1 | 8/2011 |
| WO | WO 2012/149299 A2 | 11/2012 |
| WO | WO 2013/082722 A1 | 6/2013 |
| WO | WO 2013/120086 A1 | 8/2013 |
| WO | WO 2013/188600 A1 | 12/2013 |
| WO | WO 2014/197936 A1 | 12/2014 |
| WO | WO 2015/085172 A2 | 6/2015 |
| WO | WO 2016/057705 A1 | 4/2016 |

OTHER PUBLICATIONS

Wilson et al., "A Cancer and Leukemia Group B multi-center study of DA-EPOCH-rituximab in untreated diffuse large B-cell lymphoma with analysis of outcome by molecular subtype," Haematologica, vol. 97 (2012) pp. 758-765.*
Alizadeh et al., "The lymphochip: a specialized cDNA microarray for the genomic-scale analysis of gene expression in normal and malignant lymphocytes," *Cold Spring Harbor Symp. Quant. Biol.*, 64, 71-78 (1999).
Alizadeh et al., "Distinct types of diffuse large B-cell lymphoma identified by gene expression profiling," *Nature*, 403 (6769), 503-511 (2000).
Alon et al., "Broad patterns of gene expression revealed by clustering analysis of tumor and normal colon tissues probed by oligonucleotide arrays," *Proc. Natl. Acad. Sci. USA*, 96 (12), 6745-6750 (1999).
Ando et al., "Fuzzy neural network applied to gene expression profiling for predicting the prognosis of diffuse large B-cell lymphoma," *Jpn. J. Cancer Res.*, 93, 1207-1212 (2002).
Andreasson et al., "Genomic amplification of CCND2 is rare in non-Hodgkin lymphomas," *Cancer Genet. Cytogenet.*, 102 (1), 81-82 (1998).
Basso et al., "Tracking CD40 signaling during germinal center development," *Blood*, 104 (13), 4088-4096 (2004).
Bea et al., "Clinicopathologic significance and prognostic value of chromosomal imbalances in diffuse large B-cell lymphomas," *J. Clin. Oncol.*, 22 (17), 3498-3506 (2004).
Berglund et al., "Chromosomal imbalances in diffuse large B-cell lymphoma detected by comparative genomic hybridization," *Mod. Pathol.*, 15 (8), 807-816 (2002).
Bergsagel et al., "Critical roles for immunoglobulin translocations and cyclin D dysregulation in multiple myeloma," *Immunol. Rev.*, 194, 96-104 (2003).
Bishop et al., "Burkitt's lymphoma: molecular pathogenesis and treatment," *Cancer Invest.*, 18 (6), 574-583 (2000).
Blenk et al., "Germinal center B cell-like (GCB) and activated B cell-like (ABC) type of diffuse large B cell lymphoma (DLBCL): analysis of molecular predictors, signatures, cell cycle state and patient survival," *Cancer Inform.*, 3, 399-420 (2007).
Boxer et al., "Translocations involving c-myc and c-myc function," *Oncogene*, 20 (40), 5595-5610 (2001).

(56) References Cited

OTHER PUBLICATIONS

Brault et al., "PIM kinases are progression markers and emerging therapeutic targets in diffuse large B-cell lymphoma," *Br. J. Canc.*, 107 (3), 491-500 (2012).
Cao et al., "Serial analysis of gene expression of lobular carcinoma in situ identifies down regulation of claudin 4 and overexpression of matrix metalloproteinase 9," *Breast Cancer Res.*, 10 (5), 10 pp. (2008).
Chee et al., "Accessing genetic information with high-density DNA arrays," *Science*, 274 (5287), 610-614 (1996).
Chiarle et al., "Increased proteasome degradation of cyclin-dependent kinase inhibitor p27 is associated with a decreased overall survival in mantle cell lymphoma," *Blood*, 95 (2), 619-626 (2000).
Cho et al., "A genome-wide transcriptional analysis of the mitotic cell cycle," *Mol. Cell.*, 2 (1), 65-73 (1998).
Choi et al., "A new immunostain algorithm classifies diffuse large B-cell lymphoma into molecular subtypes with high accuracy," *Clin. Cancer Res.*, 15 (17), 5494-5502 (2009).
Chu et al., "The transcriptional program of sporulation in budding yeast," *Science*, 282 (5389), 699-705 (1998).
Cigudosa et al., "Cytogenetic analysis of 363 consecutively ascertained diffuse large B-cell lymphomas," *Genes Chromosomes Cancer*, 25 (2), 123-133 (1999).
Coiffier et al., "CHOP chemotherapy plus rituximab compared with CHOP alone in elderly patients with diffuse large-B-cell lymphoma," *N. Engl. J. Med.*, 346 (4), 235-242 (2002).
Collins et al., "A differential microRNA profile distinguishes cholangiocarcinoma from pancreatic adenocarcinoma," *Ann. Surg. Oncol.*, 21 (1), 133-138 (2014) Author Manuscript.
Copie-Bergman et al., "MAL expression in lymphoid cells: further evidence for MAL as a distinct molecular marker of primary mediastinal large B-cell lymphomas," *Mod Pathol.*, 15 (11), 1172-1180 (2002).
Dave et al., "Cytogenetic characterization of diffuse large cell lymphoma using multi-color fluorescence in situ hybridization," *Cancer Genet. Cytogenet.*, 132 (2), 125-132 (2002).
Dave et al., "Molecular diagnosis of Burkitt's lymphoma," *N. Engl. J. Med.*, 354 (23), 2431-2442 (2006).
Davis et al., "Constitutive nuclear factor kappaB activity is required for survival of activated B cell-like diffuse large B cell lymphoma cells," *J. Exp. Med.*, 194 (12), 1861-1874 (2001).
Davis et al., "Molecular diagnosis of lymphoid malignancies by gene expression profiling," *Curr. Opin. Hematol.*, 9 (4), 333-338 (2002).
Deeb et al., "Super-SILAC Allows Classification of Diffuse Large B-cell Lymphoma Subtypes by Their Protein Expression Profiles," *Mol. Cell. Proteomics*, 11(5), 77-89 (2012).
De Leeuw et al., "Comprehensive whole genome array CGH profiling of mantle cell lymphoma model genomes," *Hum. Mol. Genet.*, 13 (17), 1827-1837 (2004).
Delmer et al., "Overexpression of cyclin D2 in chronic B-cell malignancies," *Blood*, 85 (10), 2870-2876 (1995).
Derisi et al., "Exploring the metabolic and genetic control of gene expression on a genomic scale," *Science*, 278 (5338), 680-686 (1997).
Derisi et al., "Use of a cDNA microarray to analyse gene expression patterns in human cancer," *Nat. Genet.*, 14 (4), 457-460 (1996).
Doglioni et al., "Cyclin D3 expression in normal, reactive and neoplastic tissues," *J. Pathol.*, 185 (2), 159-166 (1998).
Dreyling et al., "How to manage mantle cell lymphoma," *Leukemia*, 28 (11), 2117-2130 (2014).
Dudoit et al., "Comparison of Discrimination Methods for the Classification of Tumors Using Gene Expression Data," *J. Am. Stat. Assoc.*, 97 (457), 77-87 (2002).
Dybkaer et al., "Molecular diagnosis and outcome prediction in diffuse large B-cell lymphoma and other subtypes of lymphoma," *Clinical Lymphoma*, 5 (1), 19-28 (2004).

Eisen et al., "Cluster analysis and display of genome-wide expression patterns," *Proc. Natl. Acad. Sci. USA*, 95 (25), 14863-14868 (1998).
Ek et al., "Parallel gene expression profiling of mantle cell lymphoma—how do we transform 'omics data into clinical practice," *Curr. Genomics*, 8 (3), 171-179 (2007).
Fernandez et al., "Genomic and gene expression profiling defines indolent forms of mantle cell lymphoma," *Cancer Res.*, 70 (4), 1408-1418 (2010).
Fernandez et al., "Using digital RNA counting and flow cytometry to compare mRNA with protein expression in acute leukemias," *PLoS One*, 7(11), e49010 (2012).
Feuerhake et al., "NFkappaB activity, function, and target-gene signatures in primary mediastinal large B-cell lymphoma and diffuse large B-cell lymphoma subtypes," *Blood*, 106 (4), 1392-1399 (2005).
Fisher et al., "Comparison of a standard regimen (CHOP) with three intensive chemotherapy regimens for advanced non-Hodgkin's lymphoma," *N. Engl. J. Med.*, 328 (14), 1002-1006 (1993).
Fortina et al., "Digital mRNA profiling," *Nat. Biotechnol.*, 26 (3), 293-294 (2008).
Fu et al., "Cyclin D1-negative mantle cell lymphoma: a clinicopathologic study based on gene expression profiling," *Blood*, 106 (13), 4315-4321 (2005).
Geiss et al., "Direct multiplexed measurement of gene expression with color-coded probe pairs," *Nat. Biotechnol.*, 26 (3), 317-325 (2008).
Goff et al., "The use of real-time quantitative polymerase chain reaction and comparative genomic hybridization to identify amplification of the REL gene in follicular lymphoma," *Br. J. Haematol.*, 111 (2), 618-625 (2000).
Golub et al., "Molecular classification of cancer: class discovery and class prediction by gene expression monitoring," *Science*, 286 (5439), 531-537 (1999).
Gress et al., "A pancreatic cancer-specific expression profile," *Oncogene*, 13 (8), 1819-1830 (1996).
Hans et al., "Confirmation of the molecular classification of diffuse large B-cell lymphoma by immunohistochemistry using a tissue microarray," *Blood*, 103 (1), 275-82 (2004).
Hans et al., "Expression of PKC-beta or cyclin D2 predicts for inferior survival in diffuse large B-cell lymphoma," *Mod. Pathol.*, 18 (10), 1377-1384 (2005).
Haralambieva et al., "Clinical, immunophenotypic, and genetic analysis of adult lymphomas with morphologic features of Burkitt lymphoma," *Am. J. Surg. Pathol.*, 29 (8), 1086-1094 (2005).
Harpole et al., "A prognostic model of recurrence and death in stage I non-small cell lung cancer utilizing presentation, histopathology, and oncoprotein expression," *Cancer Res.*, 55 (1), 51-56 (1995).
Hartmann et al., "Pathway discovery in mantle cell lymphoma by integrated analysis of high-resolution gene expression and copy number profiling," *Blood*, 116 (6), 953-961 (2010).
Heller et al., "Discovery and analysis of inflammatory disease-related genes using cDNA microarrays," *Proc. Natl. Acad. Sci. USA*, 94 (6), 2150-2155 (1997).
Henrickson et al., "Gene expression profiling in malignant lymphomas," *Adv. Exp. Med. Biol.*, 593, 134-146 (2007).
Henson et al., "Candidate genes contributing to the aggressive phenotype of mantle cell lymphoma," *Acta Histochem*, 113 (7), 729-742 (2011), Author Manuscript.
Hofmann et al., "Altered apoptosis pathways in mantle cell lymphoma detected by oligonucleotide microarray," *Blood*, 98 (3), 787-794 (2001).
Holstege et al., "Dissecting the regulatory circuitry of a eukaryotic genome," *Cell*, 95 (5), 717-728 (1998).
Huang et al., "The t(14;18) defines a unique subset of diffuse large B-cell lymphoma with a germinal center B-cell gene expression profile," *Blood*, 99 (7), 2285-2290 (2002).
Huang et al., "Retraction: Simultaneous recovery of DNA and RNA from formalin-fixed paraffin-embedded tissue and application in epidemiologic studies," *Cancer Epidemiol Biomarkers Prev*, 23 (6), 1132 (2014).
Huang et al., "Simultaneous recovery of DNA and RNA from formalin-fixed paraffin-embedded tissue and application in epide-

(56) References Cited

OTHER PUBLICATIONS miologic studies," *Cancer Epidemiol Biomarkers Prev.*, 19 (4), 973-977 (2010), retracted May 1, 2014.
Hudson et al., "Transcription signatures encoded by ultraconserved genomic regions in human prostate cancer," *Mol. Cancer*, 12, 13 pp. (2013).
Hummel et al., "A biologic definition of Burkitt's lymphoma from transcriptional and genomic profiling," *N. Engl. J. Med.*, 354 (23), 2419-2430 (2006).
Hyman et al., "Impact of DNA amplification on gene expression patterns in breast cancer," *Cancer Res.*, 62 (21), 6240-6245 (2002).
Hymowitz et al., "A20: from ubiquitin editing to tumour suppression," *Nat. Rev. Cancer*, 10 (5), 332-340 (2010).
Igarashi et al., "Factors affecting toxicity, response and progression-free survival in relapsed patients with indolent B-cell lymphoma and mantle cell lymphoma treated with rituximab: a Japanese phase II study," *Ann. Oncol.*, 13 (6), 928-943 (2002).
International Preliminary Report on Patentability, Application No. PCT/US2014/064161, dated May 10, 2016, 11 pp.
International Search Report, Application No. PCT/US2014/064161, dated Mar. 5, 2015, 7 pp.
Iqbal et al., "BCL2 translocation defines a unique tumor subset within the germinal center B-cell-like diffuse large B-cell lymphoma," *Am. J. Pathol.*, 165 (1), 159-166 (2004).
Iqbal et al., "Gene expression profiling in lymphoma diagnosis and management," *Best Pract. Res. Clin. Haematol.*, 22 (2), 191-210 (2009).
Jares et al., "Expression of retinoblastoma gene product (pRb) in mantle cell lymphomas. Correlation with cyclin D1 (PRAD1/CCND1) mRNA levels and proliferative activity," *Am. J. Pathol.*, 148 (5), 1591-1600 (1996).
Jares et al., "Genetic and molecular pathogenesis of mantle cell lymphoma: perspectives for new targeted therapeutics," *Nat. Rev. Cancer*, 7 (10), 750-762 (2007).
Khan et al., "Classification and diagnostic prediction of cancers using gene expression profiling and artificial neural networks," *Nat. Med.*, 7 (6), 673-679 (2001).
Khouri et al., "Hyper-CVAD and high-dose methotrexate/cytarbine followed by stem cell transplantation: an active regimen for aggressive mantle cell lymphoma," *J. Clin. Oncol* 16 (12), 3803-3809 (1998).
Kovacs, "Consistent chromosome 3p deletion and loss of heterozygosity in renal cell carcinoma," *Proc. Natl. Acad. Sci. USA*, 85 (5), 1571-1573 (1988).
Kramer et al., "Clinical relevance of BCL2, BCL6, and MYC rearrangements in diffuse large B-cell lymphoma," *Blood*, 92 (9), 3152-3162 (1998).
Kusumoto et al., "Diffuse large B-cell lymphoma with extra Bcl-2 gene signals detected by FISH analysis is associated with a 'non-germinal center phenotype'," *Am. J. Surg. Pathol.*, 29 (8), 1063-1073 (2005).
Lafage-Pochitaloff-Huvale et al., "The gene for human thioredoxin maps on the short arm of chromosome 3 at bands 3p11-p12," *FEBS Lett.*, 255 (1), 89-91 (1989).
Lashkari et al., "Yeast microarrays for genome wide parallel genetic and gene expression analysis," *Proc. Natl. Acad. Sci. USA*, 94 (24), 13057-13062 (1997).
Lenz et al., "Oncogenic CARD11 mutations in human diffuse large B cell lymphoma," *Science*, 319 (5870), 1676-1679 (2008).
Lenz et al., "Stromal gene signatures in large-B-cell lymphomas," *N. Engl. J. Med.*, 359 (22), 2313-2323 (2008).
Li, "Survival prediction of diffuse large-B-cell lymphoma based on both clinical and gene expression information," *Bioinformatics*, 22 (4), 466-471 (2006).
Lipshutz et al., "Using oligonucleotide probe arrays to access genetic diversity," *Biotechniques*, 19 (3), 442-447 (1995).
Lockhart et al., "Expression monitoring by hybridization to high-density oligonucleotide arrays," *Nat. Biotechnol.*, 14 (13), 1675-1680 (1996).
Mahadevan et al., "Transcript profiling in peripheral T-cell lymphoma, not otherwise specified, and diffuse large B-cell lymphoma identifies distinct tumor profile signatures," *Mol. Cancer. Ther.*, 4 (12), 1867-1879 (2005).
Martinez et al., "The molecular signature of mantle cell lymphoma reveals multiple signals favoring cell survival," *Cancer Res.*, 63 (23), 8226-8232 (2003).
Matsumura et al., "Gene expression analysis of plant host-pathogen interactions by SuperSAGE," *Proc. Natl. Acad. Sci. USA*, 100 (26), 15718-15723 (2003).
Meyer et al., "Immunohistochemical methods for predicting cell of origin and survival in patients with diffuse large B-cell lymphoma treated with rituximab," *J. Clin. Oncol.*, 29 (2), 200-207 (2011).
Mircean et al., "Pathway analysis of informative genes from microarray data reveals that metabolism and signal transduction genes distinguish different subtypes of lymphomas," *Int. J. Oncol.*, 24 (3), 497-504 (2004).
Monni et al., "DNA copy number changes in diffuse large B-cell lymphoma—comparative genomic hybridization study," *Blood*, 87 (12), 5269-5278 (1996).
Montgomery et al., "Pathology consultation on intermediate-to-large B-cell lymphomas," *Am. J. Clin. Pathol.*, 141 (3), 305-317 (2014).
Monti et al., "Molecular profiling of diffuse large B-cell lymphoma identifies robust subtypes including one characterized by host inflammatory response," *Blood*, 105 (5), 1851-1861 (2005).
Mortazavi et al., "Mapping and quantifying mammalian transcriptomes by RNA-Seq," *Nat Methods*, 5 (7), 621-628 (2008).
Mounier et al., "Rituximab plus CHOP (R-CHOP) overcomes bcl-2-associated resistance to chemotherapy in elderly patients with diffuse large B-cell lymphoma (DLBCL)," *Blood*, 101 (11), 4279-4284 (2003).
Neri et al., "Different regions of the immunoglobulin heavy-chain locus are involved in chromosomal translocations in distinct pathogenetic forms of Burkitt lymphoma," *Proc. Natl. Acad. Sci. USA*, 85 (8), 2748-2752 (1988).
Ngo et al., "A loss-of-function RNA interference screen for molecular targets in cancer," *Nature*, 441 (7089), 106-110 (2006).
Northcott et al., "Rapid, reliable, and reproducible molecular subgrouping of clinical medulloblastoma samples," *Acta Neruopathol.*, 123 (4), 615-626 (2012).
Nyman et al., "Prognostic impact of immunohistochemically defined germinal center phenotype in diffuse large B-cell lymphoma patients treated with immunochemotherapy," *Blood*, 109 (11), 4930-4935 (2007).
Orsetti et al., "Genomic and expression profiling of chromosome 17 in breast cancer reveals complex patterns of alterations and novel candidate genes," *Cancer Res.*, 64 (18), 6453-6460 (2004).
Ortega-Paino et al., "Functionally associated targets in mantle cell lymphoma as defined by DNA microarrays and RNA interference," *Blood*, 111 (3), 1617-1624 (2008).
Ott et al., "Cyclin D1 expression in mantle cell lymphoma is accompanied by downregulation of cyclin D3 and is not related to the proliferative activity," *Blood*, 90 (8), 3154-3159 (1997).
Payton et al., "High throughput digital quantification of mRNA abundance in primary human acute myeloid leukemia samples," *J. Clin. Invest.*, 119 (6), 1714-1726 (2009).
Pease et al., "Light-generated oligonucleotide arrays for rapid DNA sequence analysis," *Proc. Natl. Acad. Sci. USA*, 91 (11), 5022-5026 (1994).
Pietu et al., "Novel gene transcripts preferentially expressed in human muscles revealed by quantitative hybridization of a high density cDNA array," *Genome Res.*, 6 (6), 492-503 (1996).
Pruneri et al., "Immunoreactivity for cyclin D3 is frequently detectable in high-grade primary gastric lymphomas in the absence of the t(6;14)(p21.1;q32.3) chromosomal translocation," *J. Pathol.*, 200 (5), 596-601 (2003).
Puvvada et al., "Molecular classification, pathway addiction, and therapeutic targeting in diffuse large B-cell lymphoma," *Cancer Genet.*, 206, 257-265 (2013), Author Manuscript.
Quek et al., "A multiplex assay to measure RNA transcripts of prostate cancer in urine," *PLoS One*, 7 (9), e45656 (2012).

(56) References Cited

OTHER PUBLICATIONS

Quintanilla-Martinez et al., "Mantle cell lymphomas lack expression of p27Kip1, a cyclin-dependent kinase inhibitor," *Am. J. Pathol.*, 153 (1), 175-182 (1998).
Radmacher et al., "A paradigm for class prediction using gene expression profiles," *J. Comput. Biol.*, 9 (3), 505-511 (2002).
Ramaswamy et al., "Recurrence patterns across medulloblastoma subgroups: an integrated clinical and molecular analysis," *Lancet Oncol.*, 14 (12), 1200-1207 (2013), Author Manuscript.
Ramaswamy et al., "Multiclass cancer diagnosis using tumor gene expression signatures," *Proc. Natl. Acad. Sci. USA*, 98 (26), 15149-15154 (2001).
Ransohoff, "Rules of evidence for cancer molecular-marker discovery and validation," *Nat. Rev. Cancer*, 4 (4), 309-314 (2004).
Rao et al., "Chromosomal and gene amplification in diffuse large B-cell lymphoma," *Blood*, 92 (1), 234-240 (1998).
Rimsza et al., "Loss of MHC class II gene and protein expression in diffuse large B-cell lymphoma is related to decreased tumor immunosurveillance and poor patient survival regardless of other prognostic factors: a follow-up study from the Leukemia and Lymphoma Molecular Profiling Project," *Blood*, 103 (11), 4251-4258 (2004).
Rizzatti et al., "Gene expression profiling of mantle cell lymphoma cells reveals aberrant expression of genes from the PI3K-AKT, WNT and TGFbeta signalling pathways," *Br. J. Haematol.*, 130 (4), 516-526 (2005).
Robetorye et al., "Microarray analysis of b-cell lymphoma cell lines with the t(14;18)," *J. Mol. Diag.*, 4 (3), 123-136 (2002).
Rogge et al., "Gene Profiling of Lymphoma, myeloma, and AML," *Medscape from WebMed*, 5 (3), 1-8 (2003).
Rosenwald, "DNA microarrays in lymphoid malignancies," *Oncology*, 8 pp. (2003), Web.
Rosenwald et al., "Gene expression profiling of diffuse large B-cell lymphoma," *Leukemia & Lymphoma*, 44 (Supp. 3), S41-S47 (2003).
Rosenwald et al., "Molecular diagnosis of primary mediastinal B cell lymphoma identifies a clinically favorable subgroup of diffuse large B cell lymphoma related to Hodgkin lymphoma," *J. Exp. Med.*, 198 (6), 851-862 (2003).
Rosenwald et al., "The proliferation gene expression signature is a quantitative integrator of oncogenic events that predicts survival in mantle cell lymphoma," *Cancer Cell*, 3 (2), 185-197 (2003).
Rosenwald et al., "The use of molecular profiling to predict survival after chemotherapy for diffuse large-B-cell lymphoma," *N. Engl. J. Med.*, 346 (25), 1937-1947 (2002).
Rubio-Moscardo et al., "Mantle-cell lymphoma genotypes identified with CGH to BAC microarrays define a leukemic subgroup of disease and predict patient outcome," *Blood*, 105 (11), 4445-4454 (2005).
Rummel et al., "Bendamustine plus rituximab versus CHOP plus rituximab as first-line treatment for patients with indolent and mantle-cell lymphomas: an open-label, multicentre, randomised, phase 3 non-inferiority trial," *Lancet*, 381 (9873), 1203-1210 (2013).
Salaverria et al., "Specific secondary genetic alterations in mantle cell lymphoma provide prognostic information independent of the gene expression-based proliferation signature," *J. Clin. Oncol.*, 25 (10), 1216-1222 (2007).
Savage et al., "The molecular signature of mediastinal large B-cell lymphoma differs from that of other diffuse large B-cell lymphomas and shares features with classical Hodgkin lymphoma," *Blood*, 102 (12), 3871-3879 (2003).
Schena et al., "Parallel human genome analysis: Microarray-based expression monitoring of 1000 genes," *Proc. Natl. Acad. Sci. USA*, 93, 10614-1061 9 (1996).
Schena et al., "Quantitative monitoring of gene expression patterns with a complementary DNA microarray," *Science*, 270 (5235), 467-470 (1995).
Schmechel et al., "Identification of genes whose expression patterns differ in benign lymphoid tissue and follicular, mantle cell, and small lymphocytic lymphoma," *Leukemia*, 18, 841-855 (2004).

Schwaenen et al., "DNA microarray analysis in malignant lymphomas," *Ann Hematol.*, 82 (6), 323-332 (2003).
Scott et al., "Determining cell-of-origin subtypes of diffuse large B-cell lymphoma using gene expression in formalin-fixed paraffin-embedded tissue," *Blood*, 123 (8), 1214-1217 (2014).
Sehn et al., "The revised International Prognostic Index (R-IPI) is a better predictor of outcome than the standard IPI for patients with diffuse large B-cell lymphoma treated with R-CHOP," *Blood*, 109 (5), 1857-1861 (2007).
Shaffer et al., "A library of gene expression signatures to illuminate normal and pathological lymphoid biology," *Immunol. Rev.*, 210, 67-85 (2006).
Shaffer et al., "Lymphoid malignancies: the dark side of B-cell differentiation," *Nat. Rev. Immunol.*, 2 (12), 920-932 (2002).
Shaffer et al., "Signatures of the immune response," *Immunity*, 15 (3), 375-385 (2001).
Shalon et al., "A DNA microarray system for analyzing complex DNA samples using two-color fluorescent probe hybridization," *Genome Res.*, 6 (7), 639-645 (1996).
Shipp et al., "A predictive model for aggressive non-Hodgkin's lymphoma. The International Non-Hodgkin's Lymphoma Prognostic Factors Project," *N. Engl. J. Med.*, 329 (14), 987-994 (1993).
Shipp et al., "Diffuse large B-cell lymphoma outcome prediction by gene-expression profiling and supervised machine learning," *Nat. Med*, 8 (1), 68-74 (2002).
Sonoki et al., "Cyclin D3 is a target gene of t(6;14)(p21.1;q32.3) of mature B-cell malignancies," *Blood*, 98 (9), 2837-2844 (2001).
Southern et al., "Arrays of complementary oligonucleotides for analysing the hybridisation behaviour of nucleic acids," *Nucleic Acids. Res.*, 22 (8), 1368-1373 (1994).
Spellman et al., "Comprehensive identification of cell cycle-regulated genes of the yeast *Saccharomyces cerevisiae* by microarray hybridization," *Mol. Biol. Cell*, 9 (12), 3273-3297 (1998).
Staudt et al., "The biology of human lymphoid malignancies revealed by gene expression profiling," *Adv. Immunol.*, 87, 163-208 (2005), Author Manuscript.
Staudt et al., "Focus on lymphomas," *Cancer Cell*, 2 (5), 363-366 (2002).
Staudt, "Gene expression profiling of lymphoid malignancies," *Annu. Rev. Med.*, 53, 303-318 (2002).
Staudt et al., "Genomic views of the immune system*," *Annu. Rev. Immunol.*, 18, 829-859 (2000).
Staudt et al., "Molecular diagnosis of the hematologic cancers," *N. Engl. J. Med.*, 348 (18), 1777-1785 (2003).
Staudt, "Its All in the diagnosis," *Cancer Cell*, 1 (2), 109-110 (2002).
Subramanian et al., "Gene set enrichment analysis: a knowledge-based approach for interpreting genome-wide expression profiles," *Proc. Natl. Acad. Sci. USA*, 102 (43), 15545-15550 (2005).
Tagawa et al., "Comparison of genome profiles for identification of distinct subgroups of diffuse large B-cell lymphoma," *Blood*, 106 (5), 1770-1777 (2005).
Tamayo et al., "Interpreting patterns of gene expression with self-organizing maps: methods and application to hematopoietic differentiation," *Proc. Natl. Acad. Sci. USA*, 96 (6), 2907-2912 (1999).
Tavazoie et al., "Systematic determination of genetic network architecture," *Nature Genet.*, 22 (3), 281-285 (1999).
Thieblemont et al., "Small lymphocytic lymphoma, marginal zone B-cell lymphoma, and mantle cell lymphoma exhibit distinct gene-expression profiles allowing molecular diagnosis," *Blood*, 103 (7), 2727-2737 (2004).
Tibshirani et al., "Diagnosis of multiple cancer types by shrunken centroids of gene expression," *Proc. Natl. Acad. Sci. USA*, 99 (10), 6567-6572 (2002).
Triscott et al., "Personalizing the treatment of pediatric medulloblastoma: Polo-like kinase 1 as a molecular target in high-risk children," *Cancer Res.*, 73 (22), 6734-6744 (2013).
Van Der Velden et al., "B-cell prolymphocytic leukemia: a specific subgroup of mantle cell lymphoma," *Blood*, 124 (3), 412-419 (2014).
Velculescu et al., "Serial analysis of gene expression," *Science*, 270 (5235), 484-487 (1995).

(56) References Cited

OTHER PUBLICATIONS

Wells, "Lymphoma microenvironment impacts therapy and prognosis," *Hematology Times*, 3 pp. (2008), http://www.hematologytimes.com/ht/p_article_print.do?id=437§ion.

Wiestner et al., "Towards molecular diagnosis and targeted therapy of lymphoid malignancies," *Semin. Hematol.*, 40 (4), 296-307 (2003).

Winter et al., "Prognostic significance of Bcl-6 protein expression in DLBCL treated with CHOP or R-CHOP: a prospective correlative study," *Blood*, 107 (11), 4207-4213 (2006).

Wodicka et al., "Genome-wide expression monitoring in *Saccharomyces cerevisiae*," *Nat. Biotechnol.*, 15 (13), 1359-1367 (1997).

Wright et al., "A gene expression-based method to diagnose clinically distinct subgroups of diffuse large B cell lymphoma," *Proc. Natl. Acad. Sci. USA*, 100 (17), 9991-9996 (2003).

Written Opinion of the International Searching Authority, Application No. PCT/US2014/064161, dated Jul. 2009, 10 pp.

Wuthrich et al., "MHC class II, antigen presentation and tumor necrosis factor in renal tubular epithelial cells," *Kidney Int.*, 37 (2), 783-792 (1990).

Xiu et al., "Analysis of survivin expression in subtypes of lymphoma," *Chinese J. Can.*, 23 (6), 655-661 (2004).

Yatabe et al., "Significance of cyclin D1 overexpression for the diagnosis of mantle cell lymphoma: a clinicopathologic comparison of cyclin D1-positive MCL and cyclin D1-negative MCL-like B-cell lymphoma," *Blood*, 95 (7), 2253-2261 (2000).

Ye et al., "Variable frequencies of t(11;18)(q21;q21) in MALT lymphomas of different sites: significant association with CagA strains of H pylori in gastric MALT lymphoma," *Blood*, 102 (3), 1012-1018 (2003).

Zeller et al., "An integrated database of genes responsive to the Myc oncogenic transcription factor: identification of direct genomic targets," *Genome Biol.*, 4 (10), 10 pp. (2003).

Zhang et al., "Lenalidomide efficacy in activated B-cell-like subtype diffuse large B-cell lymphoma is dependent upon IRF4 and cereblon expression," *Br. J. Haemotology*, 160 (4), 487-502 (2012).

Japanese Patent Office, Office Action dated Oct. 16, 2018 in Application No. 2016-553231, with English translation, 15 pages.

U.S. Appl. No. 10/934,930, filed Sep. 3, 2004.
U.S. Appl. No. 11/493,387, filed Jul. 25, 2006.
U.S. Appl. No. 12/592,778, filed Dec. 2, 2009.
U.S. Appl. No. 12/996,489, filed Feb. 24, 2011.
U.S. Appl. No. 13/008,403, filed Jan. 18, 2011.
U.S. Appl. No. 13/409,416, filed Mar. 1, 2012.
U.S. Appl. No. 14/540,302, filed Nov. 13, 2014.
U.S. Appl. No. 14/570,316, filed Dec. 15, 2014.

* cited by examiner

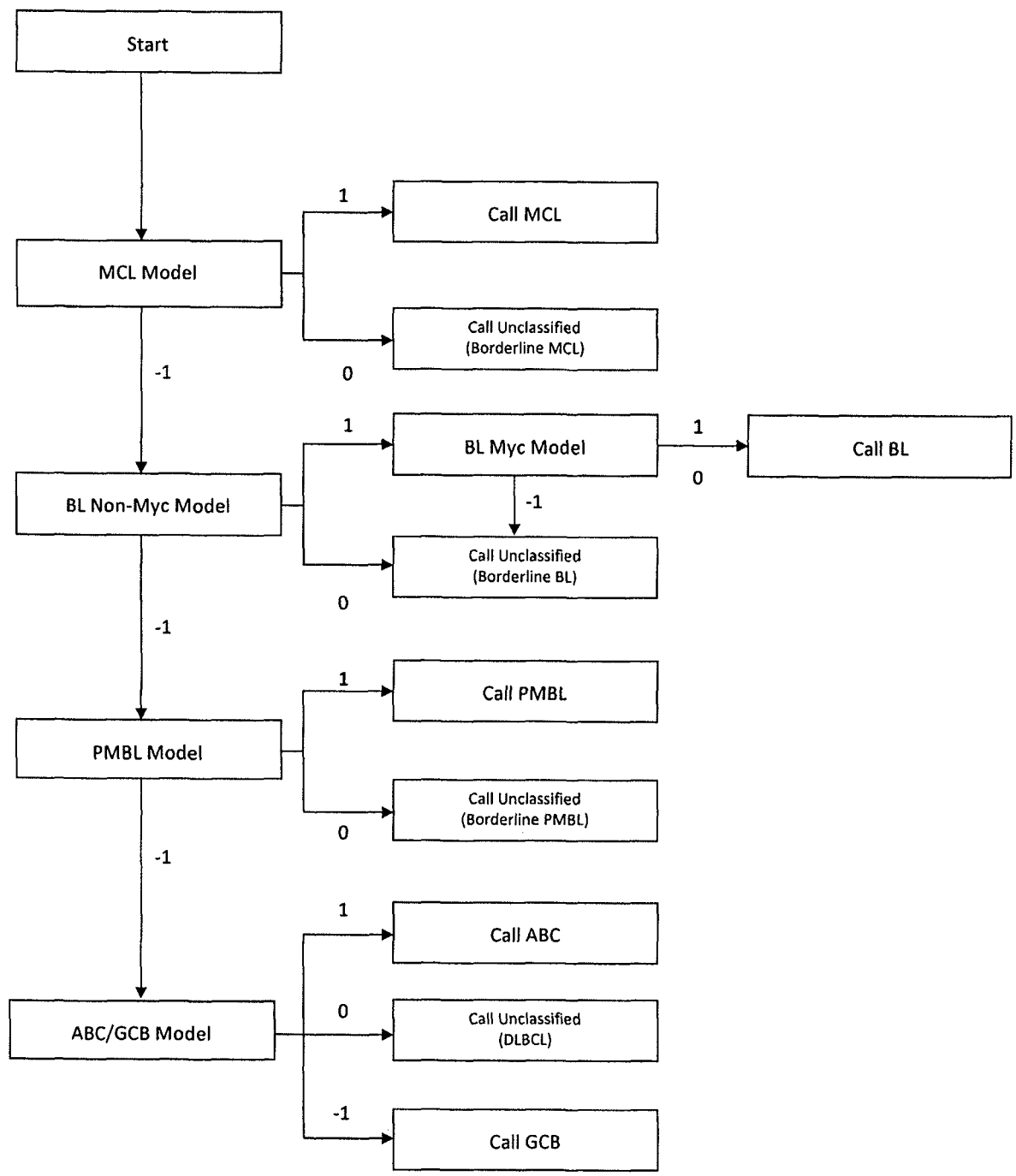

METHOD FOR SUBTYPING LYMPHOMA TYPES BY MEANS OF EXPRESSION PROFILING

CROSS-REFERENCE TO RELATED APPLICATIONS

This patent application is a U.S. National Phase of International Patent Application No. PCT/US2014/064161, filed Nov. 5, 2014, which claims the benefit of U.S. Provisional Patent Application No. 61/900,553, filed Nov. 6, 2013, each of which is incorporated herein by reference in its entirety.

STATEMENT REGARDING FEDERALLY SPONSORED RESEARCH AND DEVELOPMENT

This invention was made with Government support under grant no. U01 CA084967, awarded by National Institutes of Health. This invention was made with Government support under project number ZIA BC011006-05 by the National Institutes of Health, National Cancer Institute. The Government has certain rights in the invention.

INCORPORATED-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 520,962 Byte ASCII (Text) file named "723801_ST25.TXT," created May 6, 2016.

BACKGROUND OF THE INVENTION

A variety of systems for identifying and classifying lymphomas have been proposed over the last 25 years. In the 1980's, the Working Formulation was introduced as a method of classifying lymphomas based on morphological and clinical characteristics. In the 1990's, the Revised European-American Lymphoma (REAL) system was introduced in an attempt to take into account immunophenotypic and genetic characteristics in classifying lymphomas (Harris 1994). The most recent standard, set forth by the World Health Organization (WHO), attempts to build on these previous systems (see, Swerdlow et al., eds., *WHO Classification of Tumours of Haematopoietic and Lymphoid Tissues*, 4th ed., International Agency for Research on Cancer; World Health Organization (2008); and Jaffe, E. S., *Pathology & Genetics: Tumours of Haematopoietic and Lymphoid Tissues*, WHO Classification of Tumours, Pathology and Genetics series (2001)). The WHO classification of lymphomas is based on several factors, including tumor morphology, immunophenotype, recurrent genetic abnormalities, and clinical features.

Other diagnoses that have not been given WHO diagnostic numbers include HIV-associated lymphoma, germinal center B cell-like subtype of diffuse large B cell lymphoma, activated B cell-like subtype of diffuse large B-cell lymphoma, follicular hyperplasia (non-malignant), and infectious mononucleosis (non-malignant).

Although the WHO classification has proven useful in patient management and treatment, patients assigned to the same WHO diagnostic category often have noticeably different clinical outcomes. In many cases, these different outcomes appear to be due to molecular differences between tumors that cannot be readily observed by analyzing tumor morphology.

Diffuse large B cell lymphoma (DLBCL) can be classified as the germinal center B cell (GCB) subtype or the activated B cell (ABC) subtype based on the cell-of-origin (COO) distinction as molecularly described previously by the Lymphoma/Leukemia Molecular Profiling Project (LLMPP) (see Alizadeh et al., *Nature*, 403: 503-511 (2000)). However, more accurate diagnostic assays are needed to qualify patients for clinical trials using targeted agents and to use as a predictive biomarker.

Therefore, more precise methods are needed for identifying and classifying lymphomas based on their molecular characteristics. The invention provides such methods.

BRIEF SUMMARY OF THE INVENTION

The invention provides a method for selecting a treatment option for an activated B cell-like diffuse large B cell lymphoma (ABC DLBCL) subject, a germinal center B cell-like diffuse large B cell lymphoma (GCB DLBCL) subject, a primary mediastinal B cell lymphoma (PMBL) subject, a Burkitt lymphoma (BL) subject, or a mantle cell lymphoma (MCL) subject. The method comprises: (a) isolating a gene expression product from a biopsy sample from a lymphoma subject; (b) obtaining digital gene expression data from the isolated gene expression product, wherein the digital gene expression data comprises data for genes in a gene expression signature, and wherein the gene expression signature comprises at least one of the genes listed in Table 2; (c) generating a weighted average of the expression levels of genes from the gene expression signature to thereby obtain a gene expression signature value; (d) calculating a predictor score based on the gene expression signature value; (e) classifying the subject as belonging to one of the following groups based on the predictor score of (d): (i) ABC DLBCL, (ii) GCB DLBCL, (iii) PMBL, (iv) BL, or (v) MCL; (f) selecting a treatment option for the subject based on the subject's classification in (e); and (g) providing the treatment option to the subject.

The invention also provides a method for selecting a treatment option for a diffuse large B cell lymphoma (DLBCL) subject. The method comprises: (a) isolating a gene expression product from a biopsy sample from a DLBCL subject; (b) obtaining digital gene expression data from the isolated gene expression product, wherein the digital gene expression data comprises data for genes in a gene expression signature, and wherein the gene expression signature comprises at least one of the following genes: ASB13 (GenBank Accession No. NM_024701.3), CCDC50 (GenBank Accession No. NM_174908.3), CREB3L2 (GenBank Accession No. NM_194071.2), CYB5R2 (GenBank Accession No. NM_016229.3), IRF4 (GenBank Accession No. NM_002460.1), ISY1 (GenBank Accession No. NM_020701.2), ITPKB (GenBank Accession No. NM_002221.3), LIMD1 (GenBank Accession No. NM_014240.2), MAML3 (GenBank Accession No. NM_018717.4), MME (GenBank Accession No. NM_000902.2), MYBL1 (GenBank Accession No. XM_034274.14), PIM2 (GenBank Accession No. NM_006875.2), R3HDM1 (GenBank Accession No. NM_015361.2), RAB7L1 (GenBank Accession No. NM_001135664.1), S1PR2 (GenBank Accession No. NM_004230.2), SERPINA9 (GenBank Accession No. NM_001042518.1), TNFRSF13B (GenBank Accession No. NM_012452.2), TRIM56 (GenBank Accession No.

NM_030961.1), UBXN4 (GenBank Accession No. NM_014607.3), and WDR55 (GenBank Accession No. NM_017706.4); (c) generating a weighted average of the expression levels of genes from the gene expression signature to thereby obtain a gene expression signature value; (d) calculating a predictor score based on the gene expression signature value; (e) classifying the subject as belonging to one of the following groups based on the predictor score of (d): (i) activated B cell-like diffuse large B cell lymphoma (ABC DLBCL) or (ii) germinal center B cell-like diffuse large B cell lymphoma (GCB DLBCL); (f) selecting a treatment option for the subject based on the subject's classification in (e); and (g) providing the treatment option to the subject.

The invention provides a method for selecting a germinal center B cell-like diffuse large B cell lymphoma (GCB DLBCL) subject for treatment with R-CHOP (rituxan, cyclophosphamide, hydroxydaunorubicin, oncovin (vincristine), and prednisone) therapy. The method comprises the steps of: (a) isolating a gene expression product from a biopsy sample from a DLBCL subject; (b) obtaining digital gene expression data from the isolated gene expression product, wherein the digital gene expression data comprises data for genes in a gene expression signature, and wherein the gene expression signature comprises at least one of the following genes: ASB13 (GenBank Accession No. NM_024701.3), CCDC50 (GenBank Accession No. NM_174908.3), CREB3L2 (GenBank Accession No. NM_194071.2), CYB5R2 (GenBank Accession No. NM_016229.3), IRF4 (GenBank Accession No. NM_002460.1), ISY1 (GenBank Accession No. NM_020701.2), ITPKB (GenBank Accession No. NM_002221.3), LIMD1 (GenBank Accession No. NM_014240.2), MAML3 (GenBank Accession No. NM_018717.4), MME (GenBank Accession No. NM_000902.2), MYBL1 (GenBank Accession No. XM_034274.14), PIM2 (GenBank Accession No. NM_006875.2), R3HDM1 (GenBank Accession No. NM_015361.2), RAB7L1 (GenBank Accession No. NM_001135664.1), S1PR2 (GenBank Accession No. NM_004230.2), SERPINA9 (GenBank Accession No. NM_001042518.1), TNFRSF13B (GenBank Accession No. NM_012452.2), TRIM56 (GenBank Accession No. NM_030961.1), UBXN4 (GenBank Accession No. NM_014607.3), and WDR55 (GenBank Accession No. NM_017706.4); (c) generating a weighted average of the expression levels of genes from the gene expression signature to thereby obtain a gene expression signature value; (d) calculating a predictor score based on the gene expression signature value; (e) classifying the subject as belonging to one of the following groups based on the predictor score of (d): (i) activated B cell-like diffuse large B cell lymphoma (ABC DLBCL) or (ii) germinal center B cell-like diffuse large B cell lymphoma (GCB DLBCL); (f) selecting a GCB DLBCL subject for R-CHOP therapy; and (g) providing R-CHOP therapy to the GCB DLBCL subject and providing a different therapy to an ABC DLBCL subject.

BRIEF DESCRIPTION OF THE SEVERAL VIEWS OF THE DRAWING(S)

The FIGURE is a diagram which illustrates the logic employed in classifying a subject having (i) ABC DLBCL, (ii) GCB DLBCL, (iii) PMBL, (iv) BL, or (v) MCL based on the predictor models disclosed herein.

DETAILED DESCRIPTION OF THE INVENTION

Gene expression profiling of a cancer cell or biopsy reflects the molecular phenotype of a cancer at the time of diagnosis. As a consequence, the detailed picture provided by the genomic expression pattern provides a basis for a new systematic classification of cancers and more accurate predictors of survival and response to treatment. The invention discloses methods for identifying, diagnosing, and/or classifying a lymphoma, lymphoid malignancy, or lymphoproliferative disorder based on its gene expression patterns. The information obtained using these methods will be useful in evaluating the optimal therapeutic approach to be employed with regards to a particular subject.

The term "lymphoproliferative disorder" as used herein refers to any tumor of lymphocytes, and may refer to both malignant and benign tumors. The terms "lymphoma" and "lymphoid malignancy" as used herein refer specifically to malignant tumors derived from lymphocytes and lymphoblasts. Examples of lymphomas include, but are not limited to, follicular lymphoma (FL), Burkitt lymphoma (BL), mantle cell lymphoma (MCL), follicular hyperplasia (FH), small cell lymphocytic lymphoma (SLL), mucosa-associated lymphoid tissue lymphoma (MALT), splenic lymphoma, multiple myeloma, lymphoplasmacytic lymphoma, post-transplant lymphoproliferative disorder (PTLD), lymphoblastic lymphoma, nodal marginal zone lymphoma (NMZ), germinal center B cell-like diffuse large B cell lymphoma (GCB), activated B cell-like diffuse large B cell lymphoma (ABC), and primary mediastinal B cell lymphoma (PMBL).

The phrase "lymphoma type" (or simply "type") as used herein refers to a diagnostic classification of a lymphoma. The phrase may refer to a broad lymphoma class (e.g., DLBCL, FL, MCL, etc.) or to a subtype or subgroup falling within a broad lymphoma class (e.g., GCB DLBCL and ABC DLBCL). In one embodiment, the invention comprises selecting a treatment option for a subject having activated B cell-like diffuse large B cell lymphoma (ABC DLBCL), a germinal center B cell-like diffuse large B cell lymphoma (GCB DLBCL), primary mediastinal B cell lymphoma (PMBL), Burkitt lymphoma (BL), or mantle cell lymphoma (MCL).

The inventive method comprises isolating a gene expression product from a subject, e.g., from a biopsy sample from a subject, such as from a snap-frozen biopsy sample from a subject or a formalin-fixed and paraffin-embedded (FFPE) biopsy sample from a subject. The term "gene expression product," as used herein, refers to any molecule that is produced as a result of gene transcription. The gene expression product can be, for example, total cellular mRNA, rRNA, cDNA obtained by reverse transcription of total cellular mRNA, or a protein. The gene expression product can be obtained from the subject in any suitable manner. For example, one or more biopsy samples can be obtained from a patient that has been diagnosed as having a particular lymphoma type, and the biopsy samples can be formalin-fixed and paraffin-embedded using protocols that are known in the art or are commercially available (see, e.g., Keiman, J. (ed.), *Histological and Histochemical Methods: Theory and Practice*, 4th edition, Cold Spring Harbor Laboratory Press (2008)). The gene expression product can be extracted from an FFPE biopsy sample using methods that are known in the art or are commercially available (see, e.g., Huang et al., *Cancer Epidemiol Biomarkers Prev.*, 19: 973-977 (2010); QIAamp DNA FFPE Tissue Kit, RNAEASY™

FFPE Kit (Qiagen, Venlo, Netherlands); and MAGMAX™ FFPE DNA Isolation Kit (Life Technologies, Carlsbad, Calif.)).

The inventive method further comprises obtaining digital gene expression data from the isolated gene expression product, wherein the digital gene expression data comprises data for genes in a gene expression signature. The phrase "gene expression data" as used herein refers to information regarding the relative or absolute level of expression of a gene or set of genes in a cell or group of cells. The level of expression of a gene may be determined based on the level of RNA, such as mRNA, encoded by the gene. Alternatively, the level of expression may be determined based on the level of a polypeptide or fragment thereof encoded by the gene. "Gene expression data" may be acquired for an individual cell, or for a group of cells such as a tumor or biopsy sample. Any effective method of quantifying the expression of at least one gene, gene set, or group of gene sets may be used to acquire gene expression data for use in the invention. For example, gene expression data may be measured or estimated using one or more microarrays. The microarrays may be of any effective type, including but not limited to nucleic acid based or antibody based. Gene expression may also be measured by a variety of other techniques, including but not limited to PCR, quantitative RT-PCR, real-time PCR, RNA amplification, in situ hybridization, immunohistochemistry, immunocytochemistry, FACS, serial analysis of gene expression (SAGE) (Velculescu et al., *Science*, 270: 484-487 (1995)), Northern blot hybridization, or western blot hybridization.

Nucleic acid microarrays generally comprise nucleic acid probes derived from individual genes and placed in an ordered array on a support. This support may be, for example, a glass slide, a nylon membrane, or a silicon wafer. Gene expression patterns in a sample are obtained by hybridizing the microarray with the gene expression product from the sample. This gene expression product may be, for example, total cellular mRNA, rRNA, or cDNA obtained by reverse transcription of total cellular mRNA. The gene expression product from a sample is labeled with a radioactive, fluorescent, or other label to allow for detection. Following hybridization, the microarray is washed, and hybridization of gene expression product to each nucleic acid probe on the microarray is detected and quantified using a detection device such as a phosphorimager or scanning confocal microscope.

The microarray can be a cDNA microarray or an oligonucleotide microarray. cDNA arrays consist of hundreds or thousands of cDNA probes immobilized on a solid support, and are described in detail in, e.g., Southern et al., *Genomics*, 13: 1008-1017 (1992); Southern et al., *Nucl. Acids. Res.*, 22: 1368-1373 (1994); Gress et al., *Oncogene*, 13: 1819-1830 (1996); Pietu et al., *Genome Res.*, 6: 492-503 (1996); Schena et al., *Science*, 270: 467-470 (1995); DeRisi et al., *Nat. Genet.*, 14: 457-460 (1996); Schena et al., *Proc. Natl. Acad. Sci. USA*, 93: 10614-10619 (1996); Shalon et al., *Genome Res.*, 6: 639-645 (1996); DeRisi et al., *Science*, 278: 680-686 (1997); Heller et al., *Proc. Natl. Acad. Sci. USA*, 94: 2150-2155 (1997); and Lashkari et al., *Proc. Natl. Acad. Sci. USA*, 94: 13057-13062 (1997). Oligonucleotide arrays differ from cDNA arrays in that the probes are 20- to 25-mer oligonucleotides. Oligonucleotide arrays are generally produced by in situ oligonucleotide synthesis in conjunction with photolithographic masking techniques (see, e.g., Pease et al., *Proc. Natl. Acad. Sci. USA*, 91: 5022-5026 (1994); Lipshutz et al., *Biotechniques*, 19: 442-447 (1995); Chee et al., *Science*, 274: 610-14 (1996); Lockhart et al., *Nat. Biotechnol.*, 14: 1675-1680 (1996); and Wodicka et al., *Nat. Biotechnol.*, 15: 1359-1367 (1997)). The solid support for oligonucleotide arrays is typically a glass or silicon surface.

Methods and techniques applicable to array synthesis and use have been described in, for example, U.S. Pat. Nos. 5,143,854, 5,242,974, 5,252,743, 5,324,633, 5,384,261, 5,424,186, 5,445,934, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, and 6,410,229, and U.S. Patent Application Publication 2003/0104411. Techniques for the synthesis of microarrays using mechanical synthesis methods are described in, for example, U.S. Pat. Nos. 5,384,261 and 6,040,193. Microarrays may be nucleic acids on beads, gels, polymeric surfaces, fibers such as fiber optics, glass or any other appropriate substrate (see, e.g., U.S. Pat. Nos. 5,708,153, 5,770,358, 5,789,162, 5,800,992, and 6,040,193.

Microarrays may be packaged in such a manner as to allow for diagnostic use, or they can be an all-inclusive device (see, e.g., U.S. Pat. Nos. 5,856,174 and 5,922,591). Microarrays directed to a variety of purposes are commercially available from Affymetrix (Affymetrix, Santa Clara, Calif.).

"Digital gene expression data," as used herein, refers to gene expression information that is based on the generation of sequence tags, as opposed to "analog gene expression data" which is based on hybridization to arrayed cDNA or oligonucleotide libraries as described above.

Digital gene expression data can be obtained and analyzed using a variety of methods known in the art, such as, for example, serial analysis of gene expression (SAGE) (see, e.g., Velculescu et al., *Science*, 270(5235): 484-487 (1995)), SuperSAGE (see e.g., Matsumura et al., *Proc. Natl. Acad. Sci. USA*, 100 (26): 15718-15723 (2003)), digital northern analysis (see, e.g., Cao et al., *Breast Cancer Research*, 10: R91 (2008)), and RNA-seq (see, e.g., Mortazavi et al. *Nat Methods*, 5(7):621-628 (2008)). In one embodiment, the digital gene expression data is obtained using the NCOUNTER™ gene expression assay available from NanoString Technologies, Inc. The NCOUNTER™ assay can detect the expression of up to 800 genes in a single reaction with high sensitivity and linearity across a broad range of expression levels. The NCOUNTER™ assay is based on direct digital detection of mRNA molecules of interest using target-specific, color-coded probe pairs, and does not require the conversion of mRNA to cDNA by reverse transcription or the amplification of the resulting cDNA by PCR. Each target gene of interest is detected using a pair of reporter and capture probes carrying 35- to 50-nucleotide target-specific sequences. In addition, each reporter probe carries a unique color code at the 5' end that enables the molecular barcoding of the genes of interest, while the capture probes all carry a biotin label at the 3' end that provides a molecular handle for attachment of target genes to facilitate downstream digital detection. After solution-phase hybridization between target mRNA and reporter-capture probe pairs, excess probes are removed and the probe/target complexes are aligned and immobilized in an NCOUNTER™ cartridge, which is then placed in a digital analyzer for image acquisition and data processing. Hundreds of thousands of color codes designating mRNA targets of interest are directly imaged on the surface of the cartridge. The expression level of a gene is measured by counting the number of times the color-coded barcode for that gene is detected, and the barcode counts are then tabulated. NANOSTRING™ technology and analysis of digital gene expression data is described in detail in, e.g., Kulkarni, M. M., "Digital Multiplexed Gene Expression Analysis Using the NANOSTRING™ NCOUNTER™ System," *Current Protocols in Molecular Biology*. 94: 25B.10.1-25B.10.17 (2011); Geiss et al., *Nature Biotechnology*, 26: 317-325 (2008); and U.S. Pat. No. 7,919,237.

The term "gene expression signature" or "signature" as used herein refers to a group of coordinately expressed genes. The genes making up a particular signature may be expressed in a specific cell lineage, stage of differentiation, or during a particular biological response. The genes can reflect biological aspects of the tumors in which they are expressed, such as the cell of origin of the cancer, the nature of the non-malignant cells in the biopsy, and the oncogenic mechanisms responsible for the cancer (see, e.g., Shaffer et al., *Immunity*, 15: 375-385 (2001)). Examples of gene expression signatures include lymph node (see Shaffer et al., supra), proliferation (see, e.g., Rosenwald et al., *New Engl. J. Med.*, 346: 1937-1947 (2002)), MHC class II, ABC DLBCL high, B-cell differentiation, T-cell, macrophage, immune response-1, immune response-2, and germinal center B cell.

The invention provides gene expression signatures that can be used to classify particular types of lymphoma and then select an appropriate treatment option based on that classification. In this respect, the invention provides a novel 800 gene array for the identification and diagnosis various lymphoma types. The 800 gene array contains genes previously identified as being differentially expressed between ABC DLBCL, GCB DLBCL, PMBL, BL, and MCL, shown to be associated with survival in DLBCL or MCL, or were known in the art to be of particular importance in lymphoid biology. The genes and probe sequences that comprise the 800 gene array are set forth in Table 1.

TABLE 1

| Gene | GenBank Accession No. | Target Sequence | Capture Probe Sequence | Reporter Probe Sequence |
|---|---|---|---|---|
| DDX58 | NM_014314.3 | CTGGCATATTGACTGGACGTGGCAAAACAAATCAGAACACAGGAATGACCCTCCCGGCACAGAAGTGTATATTGGATGCATTCAAAGCCAGTGGAGATCA (SEQ ID NO: 1) | GGTCATTCCTGTGTTCTGATTTGTTTTGCCACGTCCAGTCAATATGCCAG (SEQ ID NO: 2) | TGATCTCCACTGGCTTTGAATGCATCCAATATACACTTCTGTGCCGGGAG (SEQ ID NO: 3) |
| HLA-DQA1 | NM_002122.3 | GGTGGCCTGAGTTCAGCAAATTTGGAGGTTTTGACCCGCAGGGTGCACTGAGAAACATGGCTGTGGCAAAACACAACTTGAACATCATGATTAAACGCTA (SEQ ID NO: 4) | CAGTGCACCCTGCGGGTCAAAACCTCCAAATTTGCTGAACTCAGGCCACC (SEQ ID NO: 5) | TAGCGTTTAATCATGATGTTCAAGTTGTGTTTTGCCACAGCCATGTTTCT (SEQ ID NO: 6) |
| IFI16 | NM_005531.1 | ACGACTGAACACAATCAACTGTGAGGAAGGAGATAAACTGAAACTCACCAGCTTTGAATTGGCACCGAAAAGTGGGAATACCGGGGAGTTGAGATCTGTA (SEQ ID NO: 7) | TGGTGAGTTTCAGTTTATCTCCTTCCTCACAGTTGATTGTGTTCAGTCGT (SEQ ID NO: 8) | TACAGATCTCAACTCCCCGGTATTCCCACTTTTCGGTGCCAATTCAAAGC (SEQ ID NO: 9) |
| IFNAR1 | NM_000629.2 | CTAATCAGCTCTCAGTGATCAACCCACTCTTGTTATGGGTGGTCTCTGTCACTTTGAATGCCAGGCTGGCTTCTCGTCTAGCAGTATTCAGATACCCCTT (SEQ ID NO: 10) | GACAGAGACCACCCATAACAAGAGTGGGTTGATCACTGAGAGCTGATTAG (SEQ ID NO: 11) | AAGGGGTATCTGAATACTGCTAGACGAGAAGCCAGCCTGGCATTCAAAGT (SEQ ID NO: 12) |
| IFNAR2 | NM_000874.3 | AAATACCACAAGATCATTTTGTGACCTCACAGATGAGTGGAGAAGCACACACGAGGCCTATGTCACCGTCCTAGAAGGATTCAGCGGGAACACAACGTTG (SEQ ID NO: 13) | GTGTGCTTCTCCACTCATCTGTGAGGTCACAAAATGATCTTGTGGTATTT (SEQ ID NO: 14) | TTCCCGCTGAATCCTTCTAGGACGTGACATAGGCCTCGT (SEQ ID NO: 15) |

TABLE 1-continued

| Gene | GenBank Accession No. | Target Sequence | Capture Probe Sequence | Reporter Probe Sequence |
|---|---|---|---|---|
| IFNB1 | NM_002176.2 | ACAGACTTACAGGTTACCTCCGAAACTGAAGATCTCCTAGCCTGTGCCTCTGGGACTGGACAATTGCTTCAAGCATTCTTCAACCAGCAGATGCTGTTTA (SEQ ID NO: 16) | GAGGCACAGGCTAGGAGATCTTCAGTTTCGGAGGTAACCTGTAAGTCTT (SEQ ID NO: 17) | TAAACAGCATCTGCTGGTTGAAGAATGCTTGAAGCAATTGTCCAGTCCCA (SEQ ID NO: 18) |
| IL13 | NM_002188.2 | TTTCTTTCTGATGTCAAAAATGTCTTGGGTAGGCGGGAAGGAGGGTTAGGGAGGGGTAAAATTCCTTAGCTTAGACCTCAGCCTGTGCTGCCCGTCTTCA (SEQ ID NO: 19) | CCTAACCCTCCTTCCCGCCTACCCAAGACATTTTTGACATCAGAAAGAAA (SEQ ID NO: 20) | TGAAGACGGGCAGCACAGGCTGAGGTCTAAGCTAAGGAATTTTACCCCTC (SEQ ID NO: 21) |
| IRF3 | NM_001571.4 | CTGCCCTCAACCGCAAAGAAGGGTTGCGTTTAGCAGAGGACCGGAGCAAGGACCCTCACGACCCACATAAAATCTACGAGTTTGTGAACTCAGGAGTTGG (SEQ ID NO: 22) | CTTGCTCCGGTCCTCTGCTAAACGCAACCCTTCTTTGCGGTTGAG (SEQ ID NO: 23) | CCAACTCCTGAGTTCACAAACTCGTAGATTTTATGTGGGTCGTGAGGGTC (SEQ ID NO: 24) |
| IRF5 | NM_002200.3 | GCCTGGCTCTCGGGAAAATTCAGCCATGAGCAGGGAAAGAACTCTCCCAACCCTGGGGCCTAGCTGTATAGGAGGAATTGCCTAAGGGTGGCCCACTCTTG (SEQ ID NO: 25) | GTTGGGAGAGTTCTTTTCCcTGCTCATGGCTGAATTTCCCGAGAGCCAG (SEQ ID NO: 26) | CTTAGGCAATTCCTCCTATACAGCTAGGCCCCAGG (SEQ ID NO: 27) |
| IRF7 | NM_001572.3 | CGCAGCGTGAGGGTGTGTCTTCCCTGGATAGCAGCAGCCTCAGCCTCTGCCTGTCCAGCGCCAACAGCCTCTATGACGACATCGAGTGCTTCCTTATGGA (SEQ ID NO: 28) | GCAGAGGCTGAGGCTGCTGCTATCCAGGGAAGACACAC (SEQ ID NO: 29) | TCCATAAGGAAGCACTCGATGTCGTCATAGAGGCTGTTGGCGCTGGACAG (SEQ ID NO: 30) |
| RBCK1 | NM_031229.2 | TACCAGCGATTTCTAGACCTGGGCATCTCCATTGCTGAAAACCGCAGTGCCTTCAGCTACCATTGCAAGACCCCAGATTGCAAGGGATGGTGCTTCTTTG (SEQ ID NO: 31) | GCACTGCGGTTTTCAGCAATGGAGATGCCCAGGTCTAGAAATCGC (SEQ ID NO: 32) | CAAAGAAGCACCATCCCTTGCAATCTGGGGTCTTGCAATGGTAGCTGAAG (SEQ ID NO: 33) |
| RNF31 | NM_017999.4 | ACCTCACCGATGACACACAGTTGCTCAGCTACTTCTCTACCCTTGACATCCAGCTTCGCGAGAGCCTAGAGCCAGATGCCTATGCGTTGTTCCATAAGAA (SEQ ID NO: 34) | GATGTCAAGGGTAGAGAAGTAGCTGAGCAACTGTGTGTCATCGGTGAG (SEQ ID NO: 35) | TTCTTATGGAACAACGCATAGGCATCTGGCTCTAGGCTCTCGCGAAGCTG (SEQ ID NO: 36) |

TABLE 1-continued

| Gene | GenBank Accession No. | Target Sequence | Capture Probe Sequence | Reporter Probe Sequence |
|---|---|---|---|---|
| SHARPIN | NM_030974.3 | TCTCAGAGCTCGGT TTCCCGCCAGCCGT GCAACGCTGGGTCA TCGGACGGTGCCTG TGTGTGCCTGAGCG CAGCCTTGCCTCTT ACGGGGTTCGGCA GGA (SEQ ID NO: 37) | CCGTCCGATGAC CCAGCGTTGCAC GGCTGGCGGGAA ACCG (SEQ ID NO: 38) | CCGTAAGAGGCA AGGCTGCGCTCA GGCACACACAG GCA (SEQ ID NO: 39) |
| TNIP2 | NM_024309.3 | GTCACTTGTATGGT CCCCAGGGTGGGA GCCCCATCCTGTTC TATGGAATAAAGC GTCGCCTCTCTGCC TCGAACCAGTCAAA TGGAGTATTGCGGC TGCA (SEQ ID NO: 40) | TATTCCATAGAAC AGGATGGGGCTC CCACCCTGGGGA CCATACAAGTGA C (SEQ ID NO: 41) | AGCCGCAATACT CCATTTGACTGG TTCGAGGCAGAG AGGCGACGCTT (SEQ ID NO: 42) |
| TRIM25 | NM_005082.4 | GTGAGTATGAGGA ATTTAGCCTCTTAT AGTGAAATGAGTCC AACTCTGGGCTTTG CTTAGAGGAGAGCT CCTGTCAGGCTTCC TATAATATGAAAAG AAG (SEQ ID NO: 43) | CCCAGAGTTGGA CTCATTTCACTAT AAGAGGCTAAAT TCCTCATACTCAC (SEQ ID NO: 44) | CTTCTTTTCATAT TATAGGAAGCCT GACAGGAGCTCT CCTCTAAGCAAA G (SEQ ID NO: 45) |
| A2LD1 | NM_033110.2 | AGCAAGGCACGAA GTACCAATTACTAC CCACCTCCATCTGA TAATTGTCAGCATC GATTCAACTCGGTG CACGGCTCTTGCTT CTGCTTCCCAGCAA AGT (SEQ ID NO: 46) | TGACAATTATCA GATGGAGGTGGG TAGTAATTGGTAC TTCGTGCCTTGCT (SEQ ID NO: 47) | ACTTTGCTGGGA AGCAGAAGCAA GAGCCGTGCACC GAGTTGAATCGA TGC (SEQ ID NO: 48) |
| ABCA12 | NM_015657.3 | TTTTCCTCTAACAT CGAGCCTGAACCTA AAGATCTCACAGTC GGGGTTGCCCTGCA TGGGGTCACAAAG ATCTATGGCTCAAA AGTTGCTGTTGATA ACC (SEQ ID NO: 49) | GCAACCCCGACT GTGAGATCTTTAG GTTCAGGCTCGAT GTTAGAGGAAAA (SEQ ID NO: 50) | GGTTATCAACAG CAACTTTTGAGC CATAGATCTTTG TGACCCCATGCA GG (SEQ ID NO: 51) |
| ACPP | NM_001099.2 | CAGATGGCGCTAG ATGTTTACAACGGA CTCCTTCCTCCCTA TGCTTCTTGCCACT TGACGGAATTGTAC TTTGAGAAGGGGG AGTACTTTGTGGAG ATGT (SEQ ID NO: 52) | CAAGAAGCATAG GGAGGAAGGAGT CCGTTGTAAACAT CTAGCGCCATCTG (SEQ ID NO: 53) | ACATCTCCACAA AGTACTCCCCCT TCTCAAAGTACA ATTCCGTCAAGT GG (SEQ ID NO: 54) |
| ACSL5 | NM_016234.3 | TCTGTGACACACCC CAAAAGGCATTGGT GCTGATAGGGAAT GTAGAGAAAGGCT TCACCCCGAGCCTG AAGGTGATCATCCT TATGGACCCCTTTG ATGA (SEQ ID NO: 55) | TTTCTCTACATTC CCTATCAGCACC AATGCCTTTTGGG GTGTGTCACAGA (SEQ ID NO: 56) | TCCATAAGGATG ATCACCTTCAGG CTCGGGGTGAAG CC (SEQ ID NO: 57) |
| ACTG2 | NM_001615.3 | GGGCCCTCCATTGT CCACAGGAAGTGCT | GAGAACCTGTTCT GACTTTAGAAGC | GGTTTAATGTT TCATGACTGGTA |

TABLE 1-continued

| Gene | GenBank Accession No. | Target Sequence | Capture Probe Sequence | Reporter Probe Sequence |
|---|---|---|---|---|
| | | TCTAAAGTCAGAAC AGGTTCTCCAAGGA TCCCCTCGAGACTA CTCTGTTACCAGTC ATGAAACATTAAA ACC (SEQ ID NO: 58) | ACTTCCTGTGGAC AATGGAGGGC (SEQ ID NO: 59) | ACAGAGTAGTCT CGAGGGGATCCT TG (SEQ ID NO: 60) |
| ADAM12 | NM_003474.4 | GTACTGATGTCTCC CTCGCTCGAAATTA CACGGTAATTCTGG GTCACTGTTACTAC CATGGACATGTACG GGGATATTCTGATT CAGCAGTCAGTCTC AG (SEQ ID NO: 61) | ACAGTGACCCAG AATTACCGTGTA ATTTCGAGCGAG GGAGACATCAGT AC (SEQ ID NO: 62) | CTGAGACTGACT GCTGAATCAGAA TATCCCCGTACA TGTCCATGGTAG TA (SEQ ID NO: 63) |
| ADAM28 | NM_014265.4 | GCAGAGTGGATGA CACACTCATTCCCT GCAAAGCAAATGA TACCATGTGTGGGA AGTTGTTCTGTCAA GGTGGGTCGGATA ATTTGCCCTGGAAA GGACG (SEQ ID NO: 64) | ACACATGGTATC ATTTGCTTTGCAG GGAATGAGTGTG TCATCCACTCTGC (SEQ ID NO: 65) | CGTCCTTTCCAG GGCAAATTATCC GACCCACCTTGA CAGAACAACTTC CC (SEQ ID NO: 66) |
| ADH1B | NM_000668.4 | ATAATCTTTAGTCA TCGAATCCCAGTGG AGGGGACCCTTTTA CTTGCCCTGAACAT ACACATGCTGGGCC ATTGTGATTGAAGT CTTCTAACTCTGTC TC (SEQ ID NO: 67) | AGGGCAAGTAAA AGGGTCCCCTCC ACTGGGATTCGA TGACTAAAGATT AT (SEQ ID NO: 68) | GAGACAGAGTTA GAAGACTTCAAT CACAATGGCCCA GCATGTGTATGT TC (SEQ ID NO: 69) |
| ADIPOQ | NM_004797.2 | GCTTTCTTCTCTAC CATGACACCAACTG ATCACCACTAACTC AGAGCCTCCTCCAG GCCAAACAGCCCC AAAGTCAATTAAA GGCTTTCAGTACGG TTAG (SEQ ID NO: 70) | GAGGCTCTGAGT TAGTGGTGATCA GTTGGTGTCATGG TAGAGAAGAAAG (SEQ ID NO: 71) | CTAACCGTACTG AAAGCCTTTAAT TGACTTTGGGGC TGTTTGGCCTGG AG (SEQ ID NO: 72) |
| ADO | NM_032804.5 | AGGAACTTTAATGT TCCCGACTCGGGTG ATTCCAGCTGTGTT GCTGGCAGTGTTGT CTCAACCCTCTCCC TAAAATGACTGAGC CCTGGGTTCATCTA AT (SEQ ID NO: 73) | CTGCCAGCAACA CAGCTGGAATCA CCCGAGTCGGGA ACATTAAAGTTCC T (SEQ ID NO: 74) | ATTAGATGAACC CAGGGCTCAGTC ATTTTAGGGAGA GGGTTGAGACAA CA (SEQ ID NO: 75) |
| AHCYL2 | NM_001130723.2 | CACGCATGATCACC AAAACCTTCCCATC CTGATTCTCTTCTTC TACCTCTACCCTCT CCAACTTCTCCTGG TCTTCACATATACT CTCAAAGCTAGTCT G (SEQ ID NO: 76) | AGAGGTAGAAGA AGAGAATCAGGA TGGGAAGGTTTT GGTGATCATGCG TG (SEQ ID NO: 77) | CAGACTAGCTTT GAGAGTATATGT GAAGACCAGGA GAAGTTGGAGA GGGT (SEQ ID NO: 78) |
| AHR | NM_001621.3 | CTGCTACCACATCC ACTCTAAGCAAGG ACTCTCTCAATCCT AGTTCCCTCCTGGC TGCCATGATGCAAC AAGATGAGTCTATT TATCTCTATCCTGC TTC (SEQ ID NO: 79) | GAGGGAACTAGG ATTGAGAGAGTC CTTGCTTAGAGTG GATGTGGTAGCA G (SEQ ID NO: 80) | GAAGCAGGATA GAGATAAATAG ACTCATCTTGTT GCATCATGGCAG CCAG (SEQ ID NO: 81) |
| AICDA | NM_020661.1 | GCTGCATGAAAATT CAGTTCGTCTCTCC AGACAGCTTCGGCG | AAAGGATGCGCC GAAGCTGTCTGG AGAGACGAACTG | TCCCAAAGTACG AAATGCGTCTCG TAAGTCATCAAC |

TABLE 1-continued

| Gene | GenBank Accession No. | Target Sequence | Capture Probe Sequence | Reporter Probe Sequence |
|---|---|---|---|---|
| | | CATCCTTTTGCCCC TGTATGAGGTTGAT GACTTACGAGACGC ATTTCGTACTTTGG GA (SEQ ID NO: 82) | AATTTTCATGCAG C (SEQ ID NO: 83) | CTCATACAGGGG CA (SEQ ID NO: 84) |
| AKAP2 | NM_001136562.2 | GCTTGAGCCAGGGT GCACGCAGGAATCT GTCTGGAAAAAGG CAGTTCTCACTGAG GAGGTTTGAGGCGC GCGCTCTGGGCAGG AAGCCTCCCCAGCT TTC (SEQ ID NO: 85) | TGAGAACTGCCTT TTTCCAGACAGAT TCCTGCGTGCACC CTGGCTCAAG (SEQ ID NO: 86) | TTCCTGCCCAGA GCGCGCGCCTCA AACCTCCTCAG (SEQ ID NO: 87) |
| AKAP9 | NM_005751.3 | CTGGGAAGCAGCA TGAGATTGAAGAG CTAAACAGAGAGC TGGAAGAAATGAG GGTTACCTATGGGA CTGAAGGACTGCA GCAGTTACAAGAAT TTGAAGC (SEQ ID NO: 88) | CATTTCTTCCAGC TCTCTGTTTAGCT CTTCAATCTCATG CTGCTTCCCAG (SEQ ID NO: 89) | GCTTCAAATTCT TGTAACTGCTGC AGTCCTTCAGTC CCATAGGTAACC CT (SEQ ID NO: 90) |
| AKR1C2 | NM_001354.4 | ACATACTGCATCCT ATAGTTATACCATC CACTCTGAAATCAA TGTGAATTTAACTT CAGTTCCATACAGA AACTTCTTTTCCAC AGGTAAGAAACGG TTG (SEQ ID NO: 91) | AATTCACATTGAT TTCAGAGTGGAT GGTATAACTATA GGATGCAGTATG T (SEQ ID NO: 92) | CAACCGTTTCTT ACCTGTGGAAAA GAAGTTTCTGTA TGGAACTGAAGT TA (SEQ ID NO: 93) |
| ALOX5 | NM_000698.2 | GTCAAGATCAGCA ACACTATTTCTGAG CGGGTCATGAATCA CTGGCAGGAAGAC CTGATGTTTGGCTA CCAGTTCCTGAATG GCTGCAACCCTGTG TTGA (SEQ ID NO: 94) | TCCTGCCAGTGAT TCATGACCCGCTC AGAAATAGTGTT GCTGATCTTGAC (SEQ ID NO: 95) | TCAACACAGGGT TGCAGCCATTCA GGAACTGGTAGC CAAACATCAGGT CT (SEQ ID NO: 96) |
| AMIGO2 | NM_001143668.1 | TTTCGTGCGCTTGG CTTTATTCATGAGG CTCAGGTCGGGGA AAGACTGATGGTCC ACTGTGACAGCAA GACAGGTAATGCA AATACGGATTTCAT CTGGG (SEQ ID NO: 97) | ATCAGTCTTTCCC CGACCTGAGCCT CATGAATAAAGC CAAGCGCACGAA A (SEQ ID NO: 98) | CCAGATGAAATC CGTATTTGCATT ACCTGTCTTGCT GTCACAGTGGAC C (SEQ ID NO: 99) |
| ANKRD13A | NM_033121.1 | GCCAAACTGCGCGT CGATATCACATTGC TGGGATTTGAAAAC ATGAGCTGGATAA GAGGGAGGCGTAG TTTTATATTTAAGG GAGAAGACAACTG GGCGG (SEQ ID NO: 100) | CAGCTCATGTTTT CAAATCCCAGCA ATGTGATATCGA CGCGCAGTTTGG C (SEQ ID NO: 101) | CCGCCCAGTTGT CTTCTCCCTTAA ATATAAAACTAC GCCTCCCTCTTA TC (SEQ ID NO: 102) |
| ANLN | NM_018685.2 | ATGACCTCTTCAGT GATGTCCTAGAGGA AGGTGAACTAGAT ATGGAGAAGAGCC AAGAGGAGATGGA TCAAGCATTAGCAG AAAGCAGCGAAGA ACAGGA (SEQ ID NO: 103) | CTTCTCCATATCT AGTTCACCTTCCT CTAGGACATCAC TGAAGAGGTCAT (SEQ ID NO: 104) | CTGTTCTTCGCT GCTTTCTGCTAA TGCTTGATCCAT CTCCTCTTGGCT (SEQ ID NO: 105) |

TABLE 1-continued

| Gene | GenBank Accession No. | Target Sequence | Capture Probe Sequence | Reporter Probe Sequence |
|---|---|---|---|---|
| ANO3 | NM_031418.2 | ACGCTTACTCAAAGAGCTTGAGCCAGTCTACTTCCCTCTTCCAGTCAACCGAGAGTGAATCTCAGGCTCCCACATCTATAACCTTAATCTCCACTGACAA (SEQ ID NO: 106) | GGTTGACTGGAAGAGGGAAGTAGACTGGCTCAAGCTCTTTGAGTAAGCGT (SEQ ID NO: 107) | TTGTCAGTGGAGATTAAGGTTATAGATGTGGGAGCCTGAGATTCACTCTC (SEQ ID NO: 108) |
| ANTXR1 | NM_018153.3 | GATGGGGGTCCAGCCTGCTACGGCGGATTTGACCTGTACTTCATTTTGGACAAATCAGGAAGTGTGCTGCACCACTGGAATGAAATCTATTACTTTGTGG (SEQ ID NO: 109) | TCCAAAATGAAGTACAGGTCAAATCCGCCGTAGCAGGCTGGACCCCCATC (SEQ ID NO: 110) | CCACAAAGTAATAGATTTCATTCCAGTGGTGCAGCACACTTCCTGATTTG (SEQ ID NO: 111) |
| ANUBL1 | NM_001128324.1 | TGTACCTTGAAGCTAGTTTTGGCTATGCGTGGCGGACCTATAAATACTAGAAGAGTTCCTACAGACGATCCACTTAGGAAGATGGCAGAGTACTTGGATT (SEQ ID NO: 112) | CTAGTATTTATAGGTCCGCCACGCATAGCCAAAACTAGCTTCAAGGTACA (SEQ ID NO: 113) | AATCCAAGTACTCTGCCATCTTCCTAAGTGGATCGTCTGTAGGAACTCTT (SEQ ID NO: 114) |
| APOL1 | NM_003661.3 | CCGCTTTGACCGGGATTACCAGCAGTACCATGGACTACGGAAAGAAGTGGTGGACACAAGCCCAAGCCCACGACCTGGTCATCAAAAGCCTTGACAAATT (SEQ ID NO: 115) | CCACTTCTTTCCGTAGTCCATGGTACTGCTGGTAATCCCGGTCAAAG (SEQ ID NO: 116) | AATTTGTCAAGGCTTTTGATGACCAGGTCGTGGGCTTGGGCTTGTGTCCA (SEQ ID NO: 117) |
| ARID3A | NM_005224.2 | AGAATTTAATAAAACAGGGGAAAACCAAGGAACACTTGAATTTCTCAGGTTTTGGACATTCAGAGAGATGAATTGTGAGAACAGCAAAGAAATCCATCAG (SEQ ID NO: 118) | ACCTGAGAAATTCAAGTGTTCCTTGGTTTTCCCCTGTTTTATTAAATTCT (SEQ ID NO: 119) | CTGATGGATTTCTTTGCTGTTCTCACAATTCATCTCTCTGAATGTCCAAA (SEQ ID NO: 120) |
| ARID3B | NM_006465.2 | GGGCCCATTTGAAGGTGTCTCAGACATTTGGCCAGTATGTCTTTCTCAGGGGTTTGGTCACAAAGGATGGACTCTTCCCACCCAGAGGATGCAGGGAAAG (SEQ ID NO: 121) | CCTGAGAAAGACATACTGGCCAAATGTCTGAGACACCTTCAAATGGGCCC (SEQ ID NO: 122) | ATCCTCTGGGTGGGAAGAGTCCATCCTTTGTGACCAAACC (SEQ ID NO: 123) |
| ARID5A | NM_212481.1 | CAGCAGGGCCTGGCCTCTGGGTCTTCTGTGTCCTTTGTGGGTGCCAGCGGCTGTCCTGAGGCCTACAAGCGGCTCCTATCCAGCTTCTACTGCAAGGGGA (SEQ ID NO: 124) | CCGCTGGCACCCACAAAGGACACAGAAGACCCAGAGGCCAGG (SEQ ID NO: 125) | TAGAAGCTGGATAGGAGCCGCTTGTAGGCCTCAGGACAG (SEQ ID NO: 126) |
| ARL6IP1 | NM_015161.1 | GACCATGATCGTTTCCCTTGCTGCGGTT | GGACTTGTTGTCCCACCCAAGCAAC | AG GAAG CAATA GTAAGGAAGTCA |

TABLE 1-continued

| Gene | GenBank Accession No. | Target Sequence | Capture Probe Sequence | Reporter Probe Sequence |
|---|---|---|---|---|
| | | GCTTGGGTGGGACAACAAGTCCACAACCTGCTTCTCACCTACCTGATAGTGACTTCCTTACTATTGCTTCCT (SEQ ID NO: 127) | CGCAGCAAGGGAAACGATCATGG (SEQ ID NO: 128) | CTATCAGGTAGGTGAGAAGCAGGTTGT (SEQ ID NO: 129) |
| ARNT2 | NM_014862.3 | CGGGCTCAAAGCTGGATTAGAAAGGGGAGAGGCACTTGTGACTTTGTTTGACTCTGTGACTCACTTCCTCGCTCACACCTTGTTTGAACTACTGGACTTT (SEQ ID NO: 130) | CAAACAAAGTCACAAGTGCCTCTCCCCTTTCTAATCCAGCTTTGAGCCCG (SEQ ID NO: 131) | AAAGTCCAGTAGTTCAAACAAGGTGTGAGCGAGGAAGTGAGTCACAGAGT (SEQ ID NO: 132) |
| ARNTL | NM_001178.4 | GCCACGGTGGTGCTGGCTAGAGTGTATACGTTTGGACCCAAGCTTAACTTTTCCAATGTGGAATCCTGGGCCTTCATTGGTTCCGATGTCATAGGAATCT (SEQ ID NO: 133) | AAGTTAAGCTTGGGTCCAAACGTATACACTCTAGCCAGCACCACCGTGG (SEQ ID NO: 134) | AGATTCCTATGACATCGGAACCAATGAAGGCCCAGGATTCCACATTGGAA (SEQ ID NO: 135) |
| ASB13 | NM_024701.3 | GGACACGTAGGCGGTACCACTAAGGTTTTGGTAATGAGCCATTCAAACCGACAGCAGTGTGAAGGTGTGTCAAGGTGTATATTCTCGTGGCTCGGCATTC (SEQ ID NO: 136) | CGGTTTGAATGGCTCATTACCAAAACCTTAGTGGTACCGCCTACGTGTCC (SEQ ID NO: 137) | GAATGCCGAGCCACGAGAATATACACCTTGACACACCTTCACACTGCTGT (SEQ ID NO: 138) |
| ASCL2 | NM_005170.2 | CGGGGGGCACCAACACTTGGAGATTTTTCCGGAGGGGAGAGGATTTTCTAAGGGCACAGAGAATCCATTTTCTACACATTAACTTGAGCTGCTGGAGGGA (SEQ ID NO: 139) | TAGAAAATCCTCTCCCCTCCGGAAAAATCTCCAAGTGTTGGTGCCCC (SEQ ID NO: 140) | CCTCCAGCAGCTCAAGTTAATGTGTAGAAAATGGATTCTCTGTGCCCT (SEQ ID NO: 141) |
| ASMTL-AS1 | NR_026711.1 | GGAAGTTCTCCTTCAAGTCTAACCTAAGGCCACACTGTGACGGCTCTCGGGTCAGTTCCTTCCGTGACCTCGGCACCGTGGATGCCCATGAATGCTGATC (SEQ ID NO: 142) | CCGAGAGCCGTCACAGTGTGGCCTTAGGTTAGACTTGAAG (SEQ ID NO: 143) | CATTCATGGGCATCCACGGTGCCGAGGTCACGGAAGGAACTGAC (SEQ ID NO: 144) |
| ASPM | NM_018136.4 | CAGAGATGGTACAGGGCGTACAAGACTCTTCATGATACAAGAACACATTTTTTGAAGACAAAGGCAGCTGTGATTTCCCTCCAGTCTGCTTATCGTGGCT (SEQ ID NO: 145) | AAATGTGTTCTTGTATCATGAAGAGTCTTGTACGCCCTGTACCATCTCTG (SEQ ID NO: 146) | AGCCACGATAAGCAGACTGGAGGGAAATCACAGCTGCCTTTGTCTTCAAA (SEQ ID NO: 147) |
| ATF3 | NM_001674.2 | TTTGATATACATGCTCAACCTTCATCGGCCCACGTGTATTGTCCGGGCTCAGAATGGGAGGACTCCAGAAGATGAGAGAAACCTCTTTATCCAACAGATA (SEQ ID NO: 148) | GAGCCCGGACAATACACGTGGGCCGATGAAGGTTGAGCATGTATATCAAA (SEQ ID NO: 149) | TATCTGTTGGATAAAGAGGTTTCTCTCATCTTCTGGAGTCCTCCCATTCT (SEQ ID NO: 150) |

TABLE 1-continued

| Gene | GenBank Accession No. | Target Sequence | Capture Probe Sequence | Reporter Probe Sequence |
|---|---|---|---|---|
| ATM | NM_000051.3 | ACGCTAAGTCGCTGGCCATTGGTGGACATGGCGCAGGCGCGTTTGCTCCGACGGGCCGAATGTTTTGGGGCAGTGTTTTGAGCGCGGAGACCGCGTGATA (SEQ ID NO: 151) | CGGAGCAAACGCGCCTGCGCCATGTCCACCAATGG (SEQ ID NO: 152) | CGGTCTCCGCGCTCAAAACACTGCCCCAAAACATTCGGCCCGT (SEQ ID NO: 153) |
| ATOH8 | NM_032827.6 | GGCATCCTGAGGAACTTGATAGACAAACAATGACAGTGTTTTCCAGAACTGTGGGTACGTGTCTAATCTCAGATGGTACTATGAATTCCTGGAGATCAAA (SEQ ID NO: 154) | AGTTCTGGAAAACACTGTCATTGTTTGTCTATCAAGTTCCTCAGGATGCC (SEQ ID NO: 155) | TTTGATCTCCAGGAATTCATAGTACCATCTGAGATTAGACACGTACCCAC (SEQ ID NO: 156) |
| ATP6V0E1 | NM_003945.3 | GACATGCTCTACAGTGCTCAGTCTTTGAGGTCACGAGAAGAGAATGCCTTCTAGATGCAAAATCACCTCCAAACCAGACCACTTTTCTTGACTTGCCTGT (SEQ ID NO: 157) | AAGGCATTCTCTTCTCGTGACCTCAAAGACTGAGCACTGTAGAGCATGTC (SEQ ID NO: 158) | ACAGGCAAGTCAAGAAAAGTGGTCTGGTTTGGAGGTGATTTTGCATCTAG (SEQ ID NO: 159) |
| ATXN7L2 | NM_153340.4 | ATGTCCATCTTCGGGCACTGCCCTGCCCATGATGACTTCTACTTGGTTGTGTGTAACCACTGCAGCCAAGTGGTGAAGCCTCAAGCTTTCCAGAAGCACT (SEQ ID NO: 160) | ACAACCAAGTAGAAGTCATCATGGGCAGGGCAGTGCCCGAAGATGGACAT (SEQ ID NO: 161) | GAAAGCTTGAGGCTTCACCACTTGGCTGCAGTGGTTACAC (SEQ ID NO: 162) |
| AUH | NM_001698.2 | GGTGGTCTTGAACTGGCTTTAGCCTGTGATATACGAGTAGCAGCTTCCTCTGCAAAAATGGGCCTGGTTGAAACAAAATTGGCGATTATTCCTGGTGGAG (SEQ ID NO: 163) | GAGGAAGCTGCTACTCGTATATCACAGGCTAAAGCCAGTTCAAGACCACC (SEQ ID NO: 164) | CTCCACCAGGAATAATCGCCAATTTTGTTTCAACCAGGCCCATTTTTGCA (SEQ ID NO: 165) |
| AURKA | NM_198433.1 | AGGCGCCCTGTAGGATACTGCTTGTTACTTATTACAGCTAGAGGGTCTCACTCCATTGCCCAGGCCAGAGTGCGGGGATATTTGATAAGAAACTTCAGTG (SEQ ID NO: 166) | TGAGACCCTCTAGCTGTAATAAGTAACAAGCAGTATCCTACAGGGCGC (SEQ ID NO: 167) | CACTGAAGTTTCTTATCAAATATCCCCGCACTCTGGCCTGGGCAATGGAG (SEQ ID NO: 168) |
| AUTS2 | NM_001127231.1 | CTTGTCCTTTCATTCAAAGAAGAGCAGACTCAGCCACCCACACCACTACAGCTCAGATCGAGAAAATGACCGCAATCTCTGCCAGCACCTTGGGAAGAGA (SEQ ID NO: 169) | TGTAGTGGTGTGGGTGGCTGAGTCTGCTCTTCTTTGAATGAAAGGACAAG (SEQ ID NO: 170) | TCTCTTCCCAAGGTGCTGGCAGAGATTGCGGTCATTTTCTCGATCTGAGC (SEQ ID NO: 171) |
| BANK1 | NM_001083907.1 | GGCAAATGAAATGGAAGGGGAAGGAA | TCTCCATGCCTGATCCATTCTGTTTT | TCTTCAGAACTCTCACTGCCAACC |

TABLE 1-continued

| Gene | GenBank Accession No. | Target Sequence | Capture Probe Sequence | Reporter Probe Sequence |
|---|---|---|---|---|
| | | AACAGAATGGATC AGGCATGGAGACC AAACACAGCCCACT AGAGGTTGGCAGT GAGAGTTCTGAAG ACCAGTAT (SEQ ID NO: 172) | CCTTCCCCTTCCA TTTCATTTGCC (SEQ ID NO: 173) | TCTAGTGGGCTG TGTTTGG (SEQ ID NO: 174) |
| BASP1 | NM_006317.3 | GATCCGCGTCTGAA AGTGCAGTACATCG TTTGTACCTGAAAC TGCCGCCACATGCA CTCCTCCACCGCTG AGAGTTGAATAGCT TTTCTTCTGCAATG GG (SEQ ID NO: 175) | TGGCGGCAGTTTC AGGTACAAACGA TGTACTGCACTTT CAGACGCGGATC (SEQ ID NO: 176) | CCCATTGCAGAA GAAAAGCTATTC AACTCTCAGCGG TGGAGGAGTGCA TG (SEQ ID NO: 177) |
| BATF | NM_006399.3 | CACTGTGGGTTGCA GGCCCAATGCAGA AGAGTATTAAGAA AGATGCTCAAGTCC CATGGCACAGAGC AAGGCGGGCAGGG AACGGTTATTTTTC TAAATA (SEQ ID NO: 178) | TTGAGCATCTTTC TTAATACTCTTCT GCATTGGGCCTG CAACCCA (SEQ ID NO: 179) | TATTTAGAAAAA TAACCGTTCCCT GCCCGCCTTGCT CTGTGCCATGGG AC (SEQ ID NO: 180) |
| BATF3 | NM_018664.2 | CTGCTGTTATGCAG AGCCATTTCCTCTA GAATTTGGATAATA AAGATGCTTATTGT CTCTCCCTTCTCCA GTTCTGGGAATTTA CAGGCACAATACA CTT (SEQ ID NO: 181) | AGCATCTTTATTA TCCAAATTCTAGA GGAAATGGCTCT GCATAACAGCAG (SEQ ID NO: 182) | AAGTGTATTGTG CCTGTAAATTCC CAGAACTGGAG AAGGGAGAGAC AATA (SEQ ID NO: 183) |
| BCAT1 | NM_005504.4 | CCGACGGAACAAT GAAGGATTGCAGT AACGGATGCTCCGC AGAGTGTACCGGA GAAGGAGGATCAA AAGAGGTGGTGGG GACTTTTAAGGCTA AAGACCT (SEQ ID NO: 184) | GGTACACTCTGC GGAGCATCCGTT ACTGCAATCCTTC ATTGTTCCGTCG (SEQ ID NO: 185) | AGGTCTTTAGCC TTAAAAGTCCCC ACCACCTCTTTT GATCCTCCTTCT CC (SEQ ID NO: 186) |
| BCL10 | NM_003921.2 | TGAAAATACCATCT TCTCTTCAACTACA CTTCCCAGACCTGG GGACCCAGGGGCT CCTCCTTTGCCACC AGATCTACAGTTAG AAGAAGAAGGAAC TTGT (SEQ ID NO: 187) | CTGGGTCCCCAG GTCTGGGAAGTG TAGTTGAAGAGA AGATGGTATTTTC A (SEQ ID NO: 188) | ACAAGTTCCTTC TTCTTCTAACTG TAGATCTGGTGG CAAAGGAGGAG CCC (SEQ ID NO: 189) |
| BCL2A1 | NM_004049.2 | TCATGTGTCATAAC TCAGTCAAGCTCAG TGAGCATTCTCAGC ACATTGCCTCAACA GCTTCAAGGTGAGC CAGCTCAAGACTTT GCTCTCCACCAGGC AG (SEQ ID NO: 190) | GGCAATGTGCTG AGAATGCTCACT GAGCTTGACTGA GTTATGACACAT GA (SEQ ID NO: 191) | CTGGTGGAGAGC AAAGTCTTGAGC TGGCTCACCTTG AAGCTGTTGA (SEQ ID NO: 192) |
| BCL2L10 | NM_020396.2 | TTTTATCTGAATGC ATACAAGGAGTCCT GAGGTGGTGATTTG GCCAGTGTTTTAAC TTGTGACAAGTACT CAGGTGTGAGGAC AAGAATGCAAATG GCTC (SEQ ID NO: 193) | ACACTGGCCAAA TCACCACCTCAG GACTCCTTGTATG CATTCAGATAAA A (SEQ ID NO: 194) | GAGCCATTTGCA TTCTTGTCCTCA CACCTGAGTACT TGTCACAAGTTA AA (SEQ ID NO: 195) |

TABLE 1-continued

| Gene | GenBank Accession No. | Target Sequence | Capture Probe Sequence | Reporter Probe Sequence |
| --- | --- | --- | --- | --- |
| BCL6 | NM_001706.2 | GTTGTGGACACTTGCCGGAAGTTTATTAAGGCCAGTGAAGCAGAGATGGTTTCTGCCATCAAGCCTCCTCGTGAAGAGTTCCTCAACAGCCGGATGCTGA (SEQ ID NO: 196) | ACCATCTCTGCTTCACTGGCCTTAATAAACTTCCGGCAAGTGTCCACAAC (SEQ ID NO: 197) | TCAGCATCCGGCTGTTGAGGAACTCTTCACGAGGAGCTTGATGGCAGAA (SEQ ID NO: 198) |
| BEST3 | NM_152439.2 | TCTTGCAACTAAAGCCCGGAATGAAGGTAGAATCAGAGACAGTGTTGATCTGCAATCATTGATGACTGAAATGAATCGATACCGCTCTTGGTGCAGCCTC (SEQ ID NO: 199) | GATCAACACTGTCTCTGATTCTACCTTCATTCCGGGCTTTAGTTGCAAGA (SEQ ID NO: 200) | GAGGCTGCACCAAGAGCGGTATCGATTCATTTCAGTCATCAATGATTGCA (SEQ ID NO: 201) |
| BIRC2 | NM_001166.3 | TGGGATCCACCTCTAAGAATACGTCTCCAATGAGAAACAGTTTTGCACATTCATTATCTCCCACCTTGGAACATAGTAGCTTGTTCAGTGGTTCTTACTC (SEQ ID NO: 202) | ATGTGCAAAACTGTTTCTCATTGGAGACGTATTCTTAGAGGTGGATCCCA (SEQ ID NO: 203) | GAGTAAGAACCACTGAACAAGCTACTATGTTCCAAGGTGGGAGATAATGA (SEQ ID NO: 204) |
| BIRC3 | NM_001165.3 | GTGATGTTTCTCCTGCCACCTGGAAACAAAGCATTGAAGTCTGCAGTTGAAAAGCCCAACGTCTGTGAGATCCAGGAAACCATGCTTGCAAACCACTGGT (SEQ ID NO: 205) | TCAACTGCAGACTTCAATGCTTTGTTTCCAGGTGGCAGGAGAAACATCAC (SEQ ID NO: 206) | ACCAGTGGTTTGCAAGCATGGTTTCCTGGATCTCACAGACGTTGGGCTTT (SEQ ID NO: 207) |
| BIRC5 | NM_001168.2 | CCATTCTAAGTCATTGGGGAAACGGGGTGAACTTCAGGTGGATGAGGAGACAGAATAGAGTGATAGGAAGCGTCTGGCAGATACTCCTTTTGCCACTGCT (SEQ ID NO: 208) | TCTCCTCATCCACCTGAAGTTCACCCCGTTTCCCCAATGACTTAGAATGG (SEQ ID NO: 209) | AGCAGTGGCAAAAGGAGTATCTGCCAGACGCTTCCTATCACTCTATTCTG (SEQ ID NO: 210) |
| BMP7 | NM_001719.1 | GCTTCGTCAACCTCGTGGAACATGACAAGGAATTCTTCCACCCACGCTACCACCATCGAGAGTTCCGGTTTGATCTTTCCAAGATCCCAGAAGGGGAAGC (SEQ ID NO: 211) | GTAGCGTGGGTGGAAGAATTCCTTGTCATGTTCCACGAGGTTGACGAAGC (SEQ ID NO: 212) | GCTTCCCCTTCTGGGATCTTGGAAAGATCAAACCGGAACTCTCGATGGTG (SEQ ID NO: 213) |
| BPGM | NM_199186.1 | TTTCCAGAGCTAGGCTGTGGAGTAGAGTTTGTATAGGTAACTAGGTAACTTATTGTGGCCCAGATAAGGCTTTAGGATGCCTCAGTGCTTATGTCATAGC (SEQ ID NO: 214) | AGTTACCTAGTTACCTATACAAACTCTACTCCACAGCCTAGCTCTGGAAA (SEQ ID NO: 215) | GCTATGACATAAGCACTGAGGCATCCTAAAGCCTTATCTGGGCCACAATA (SEQ ID NO: 216) |
| BPNT1 | NM_006085.4 | ACACTGTGTTGATGCGGTTGGTAGCCT | CTTTTGAGCAATAGAATATGCGGAG | ACAATACCCAGGTCTCCTTCAGCA |

TABLE 1-continued

| Gene | GenBank Accession No. | Target Sequence | Capture Probe Sequence | Reporter Probe Sequence |
|---|---|---|---|---|
| | | CGCATATTCTATTG CTCAAAAGGCAGG AATGATAGTCAGAC GTGTTATTGCTGAA GGAGACCTGGGTAT TGT (SEQ ID NO: 217) | GCTACCAACCGC ATCAACACAGTG T (SEQ ID NO: 218) | ATAACACGTCTG ACTATCATTCCT GC (SEQ ID NO: 219) |
| BSPRY | NM_017688.2 | CACTGGCCTGGTGG GCATGCTTACTCAC CTGGATGACCTCCA GCTGATTCAGAAGG AGCAAGAGATTTTC GAGAGGACCGAAG AAGCAGAGGGCAT TTTG (SEQ ID NO: 220) | GAATCAGCTGGA GGTCATCCAGGT GAGTAAGCATGC CCAC (SEQ ID NO: 221) | CAAAATGCCCTC TGCTTCTTCGGT CCTCTCGAAAAT CTCTTGCTCCTTC T (SEQ ID NO: 222) |
| BST2 | NM_004335.2 | TTCGTATGACTATT GCAGAGTGCCCATG GAAGACGGGGATA AGCGCTGTAAGCTT CTGCTGGGATAGG AATTCTGGTGCTCC TGATCATCGTGATT CTG (SEQ ID NO: 223) | TACAGCGCTTATC CCCGTCTTCCATG GGCACTCTG (SEQ ID NO: 224) | CAGAATCACGAT GATCAGGAGCAC CAGAATTCCTAT CCCCAGCAGAAG CT (SEQ ID NO: 225) |
| BTBD19 | NM_001136537.1 | TTTTTCCGCAGCAC TCCGAAGCCTTGTC AACAACCCGCGAT ACAGTGATGTTTGC TTCGTGGTTGGTCA AGAACGGCAGGAG GTATTTGCCCATCG GTGC (SEQ ID NO: 226) | CATCACTGTATCG CGGGTTGTTGAC AAGGCTTCGGAG TGCTGCGGAAAA A (SEQ ID NO: 227) | GCACCGATGGGC AAATACCTCCTG CCGTTCTTGACC AACCACGAAGC AAA (SEQ ID NO: 228) |
| BTG1 | NM_001731.2 | CAACGTGCAAATG GTAGACAGCCGAA TCAGCTGTAAGGAG GAACTTCTCTTGGG CAGAACGAGCCCTT CCAAAAACTACAAT ATGATGACTGTATC AGGT (SEQ ID NO: 229) | AGAGAAGTTCCT CCTTACAGCTGAT TCGGCTGTCTACC ATTTGCACGTTG (SEQ ID NO: 230) | ACCTGATACAGT CATCATATTGTA GTTTTTGGAAGG GCTCGTTCTGCC CA (SEQ ID NO: 231) |
| BTG2 | NM_006763.2 | TGCTCTCCTTGGGA TGATGGCTGGCTAG TCAGCCTTGCATGT ATTCCTTGGCTGAA TGGGAGAGTGCCCC ATGTTCTGCAAGAC TACTTGGTATTCTT GT (SEQ ID NO: 232) | CAAGGAATACAT GCAAGGCTGACT AGCCAGCCATCA TCCCAAGGAGAG (SEQ ID NO: 233) | ACAAGAATACCA AGTAGTCTTGCA GAACATGGGGC ACTCTCCCATTC AGC (SEQ ID NO: 234) |
| BTK | NM_000061.1 | TGATCTGGTTCAGA AATATCACCCTTGC TTCTGGATCGATGG GCAGTATCTCTGCT GCTCTCAGACAGCC AAAAATGCTATGG GCTGCCAAATTTTG GAG (SEQ ID NO: 235) | GATACTGCCCATC GATCCAGAAGCA AGGGTGATATTTC TGAACCAGATCA (SEQ ID NO: 236) | CTCCAAAATTTG GCAGCCCATAGC ATTTTTGGCTGT CTGAGAGCAGCA GA (SEQ ID NO: 237) |
| BUB1 | NM_004336.2 | CCCGGAAAATGTCC TTCAGATGCTTGAA GCCCACATGCAGA GCTACAAGGGCAA TGACCCTCTTGGTG AATGGGAAAGATA CATACAGTGGGTAG AAGAG (SEQ ID NO: 238) | CCTTGTAGCTCTG CATGTGGGCTTCA AGCATCTGAAGG ACATTTTCCGGG (SEQ ID NO: 239) | CTCTTCTACCCA CTGTATGTATCT TTCCCATTCACC AAGAGGGTCATT GC (SEQ ID NO: 240) |

TABLE 1-continued

| Gene | GenBank Accession No. | Target Sequence | Capture Probe Sequence | Reporter Probe Sequence |
|---|---|---|---|---|
| BUB1B | NM_001211.4 | GAGTCTTCTGTACCACAACGAAGCACACTAGCTGAACTAAAGAGCAAAGGGAAAAAGACAGCAAGAGCTCCAATCATCCGTGTAGGAGGTGCTCTCAAGG (SEQ ID NO: 241) | CCTTTGCTCTTTAGTTCAGCTAGTGTGCTTCGTTGTGGTACAGAAGACTC (SEQ ID NO: 242) | CCTTGAGAGCACCTCCTACACGGATGATTGGAGCTCTTGCTGTCTTTTTC (SEQ ID NO: 243) |
| C10orf18 | NM_017782.3 | CCAGAAAATACCACAGCGGCTCACAATGATCTTCCTGAAAACTCCATCGTCAACTATGACTCCCAGGCCCTAAATATGTTAGCCGATCTAGCATTAAGCT (SEQ ID NO: 244) | ACGATGGAGTTTTCAGGAAGATCATTGTGAGCCGCTGTGGTATTTTCTGG (SEQ ID NO: 245) | AGCTTAATGCTAGATCGGCTAACATATTTAGGGCCTGGGAGTCATAGTTG (SEQ ID NO: 246) |
| C13orf18 | NM_025113.2 | CCTCCCCATATCCTGAGACTGACAGTGCTTTTTTTGAGCCTTCCCATCTGACATCTGCTGCTGATGAAGGTGCTGTTCAAGTCAGTAGAAGAACCATTTC (SEQ ID NO: 247) | CAGATGGGAAGGCTCAAAAAAAGCACTGTCAGTCTCAGGATATGGGGAG (SEQ ID NO: 248) | GAAATGGTTCTTCTACTGACTTGAACAGCACCTTCATCAGCAGCAGATGT (SEQ ID NO: 249) |
| C15orf41 | NM_001130010.1 | ATTAATGGCTCGGCTTATACTGGAGAGGTTTCTACAGGAACACGAGGAAACTCCACCCTCCAAGTCTATTATAAATAGTATGCTACGGGACCCTTCTCAG (SEQ ID NO: 250) | TTTCCTCGTGTTCCTGTAGAAACCTCTCCAGTATAAGCCGAGCCATTAAT (SEQ ID NO: 251) | CTGAGAAGGGTCCCGTAGCATACTATTTATAATAGACTTGGAGGGTGGAG (SEQ ID NO: 252) |
| C19orf26 | NM_152769.2 | CGGGGCAGGTACCGTTCTGCAGTTCCTCACCCGCCTGCGCCGCCATGCCAGCCTGGATGGGGCCAGCCCCTATTTCAAGGTCAAGAAGTGGAAGCTGGAG (SEQ ID NO: 253) | TGGCATGGCGGCGCAGGCGGGTGAGGAACTGCAGAACGG (SEQ ID NO: 254) | CTTCTTGACCTTGAAATAGGGGCTGGCCCCATCCAGGC (SEQ ID NO: 255) |
| C3orf37 | NM_020187.2 | CCAAGCTGCAGTTCAATACTACCAACTGTCGTAGTGATACCGTAATGGAGAAACGGTCATTTAAGGTGCCTCTGGGAAAGGGAAGACGCTGTGTCGTTTT (SEQ ID NO: 256) | CTCCATTACGGTATCACTACGACAGTTGGTAGTATTGAACTGCAGCTTGG (SEQ ID NO: 257) | AAAACGACACAGCGTCTTCCCTTTCCCAGAGGCACCTTAAATGACCGTTT (SEQ ID NO: 258) |
| C4orf31 | NM_024574.3 | TCCAGGCTTCTCGTTCCTGGATATTGGTGCTTAGCATCTTGGCAGGGTCCGGGACGTGGACTATTCGCACACCACACCACGGGGAGGGATTTTTTCT (SEQ ID NO: 259) | GGACCCTGCCAAGATGCTAAGCACCAATATCCAGGAACGAGAAGCCTGGA (SEQ ID NO: 260) | AGAAAAAAATCCCTCCCCGTGGTGTGGTGTGCGAAATAGTCCACGTCCCC (SEQ ID NO: 261) |
| C5AR1 | NM_001736.2 | TTGCCTGTCTTTCCCAGACTTGTCCCTC | GAGAAGAGTCCCGCTGGAAAAGGA | GGGAGGGTGCTCCCTAGAAGGAA |

TABLE 1-continued

| Gene | GenBank Accession No. | Target Sequence | Capture Probe Sequence | Reporter Probe Sequence |
|---|---|---|---|---|
| | | CTTTTCCAGCGGGACTCTTCTCATCCTTCCTCATTTGCAAGGTGAACACTTCCTTCTAGGGAGCACCCTCCC (SEQ ID NO: 262) | GGGACAAGTCTGGGAAAGACAGGCAA (SEQ ID NO: 263) | GTGTTCACCTTGCAAATGAGGAAGGAT (SEQ ID NO: 264) |
| C5orf41 | NM_153607.2 | GCTCCTGTGTGTTCTTCTAAGACTCTGCAGGCTGAGGTCCCTTTGTCAGACTGTGTCCAAAAAGCAAGTAAACCCACTTCAAGCACACAAATCATGGTGA (SEQ ID NO: 265) | TCTGACAAAGGGACCTCAGCCTGCAGAGTCTTAGAAGAACACACAGGAGC (SEQ ID NO: 266) | TCACCATGATTTGTGTGCTTGAAGTGGGTTTACTTGCTTTTTGGACACAG (SEQ ID NO: 267) |
| C7orf68 | NM_013332.1 | CAACACAGAGCCCACCAAGGGCCTTCCAGACCATCCATCCAGAAGCATGTGATAAGACCTCCTTCCATACTGGCCATATTTTGGAACACTGACCTAGACA (SEQ ID NO: 268) | ACATGCTTCTGGATGGATGGTCTGGAAGGGCCCTTGGTG (SEQ ID NO: 269) | TGTCTAGGTCAGTGTTCCAAAATATGGCCAGTATGGAAGGAGGTCTTATC (SEQ ID NO: 270) |
| CA7 | NM_005182.2 | TCCCAGCCTGCAACCACTGGAGCTTTCCTATGAGGCCTGCATGTCCCTCAGCATCACCAACAATGGCCACTCTGTCCAGGTAGACTTCAATGACAGCGAT (SEQ ID NO: 271) | TGAGGGACATGCAGGCCTCATAGGAAAGCTCCAGTGGTTG (SEQ ID NO: 272) | CATTGAAGTCTACCTGGACAGAGTGGCCATTGTTGGTGATGC (SEQ ID NO: 273) |
| CACNA1D | NM_000720.2 | TATCGTGTGATTTGCAAGATGACGAGCCTGAGGAAACAAAACGAGAAGAAGAAGATGATGTGTTCAAAAGAAATGGTGCCCTGCTTGGAAACCATGTCAA (SEQ ID NO: 274) | TTCTTCTCGTTTTGTTTCCTCAGGCTCGTCATCTTGCAAATCACACGATA (SEQ ID NO: 275) | TTGACATGGTTTCCAAGCAGGGCACCATTTCTTTTGAACACATCATCTTC (SEQ ID NO: 276) |
| CALD1 | NM_033138.2 | GATTGACAGCAGACTGGAGCAGTATACCAGTGCAATTGAGGGAACAAAAAGCGCAAAACCTACAAAGCCGGCAGCCTCGGATCTTCCTGTTCCTGCTGAA (SEQ ID NO: 277) | TTTTTGTTCCCTCAATTGCACTGGTATACTGCTCCAGTCTGCTGTCAATC (SEQ ID NO: 278) | TTCAGCAGGAACAGGAAGATCCGAGGCTGCCGGCTTTGTAGGTTTTGCGC (SEQ ID NO: 279) |
| CAMK2B | NM_001220.3 | TCACCAGAAGCTGGAGAGAGAGGCTCGGATCTGCCGCCTTCGAGCCTCTCTCTTGAAGCATTCCAACATCGTGCGTCTCCACGACAGCATCTCCGAGGAGGGCTTCCACTAC (SEQ ID NO: 280) | AATGCTTCAGAAGGCGGCAGATCCGAGCCTCTCTCT (SEQ ID NO: 281) | CTCCTCGGAGATGCTGTCGTGGAGACGCACGATGTTGG (SEQ ID NO: 282) |
| CAMKK1 | NM_032294.2 | GAGCCAGAAATCAGCGAGGAGCTCAAGGACCTGATCCTGAAGATGTTAGACAAGAATCCCGAGACGAGAATTGGGGTGCCAGACATCAAGTTGCACCCTT (SEQ ID NO: 283) | TCTAACATCTTCAGGATCAGGTCCTTGAGCTCCTCGCTGATTTCTGG (SEQ ID NO: 284) | AAGGGTGCAACTTGATGTCTGGCACCCCAATTCTCGTCTCGGGATTCTTG (SEQ ID NO: 285) |

TABLE 1-continued

| Gene | GenBank Accession No. | Target Sequence | Capture Probe Sequence | Reporter Probe Sequence |
|---|---|---|---|---|
| CARD11 | NM_032415.2 | TTGAAAATCGGCCC AAGAAGGAGCAGG TTCTGGAACTGGAG CGGGAGAATGAAA TGCTGAAGACCAA AAACCAGGAGCTG CAGTCCATCATCCA GGCCGG (SEQ ID NO: 286) | ATTCTCCCGCTCC AGTTCCAGAACC TGCTCCTTCTTGG GCCGATTTTCAA (SEQ ID NO: 287) | CCGGCCTGGATG ATGGACTGCAGC TCCTGGTTTTTG GTCTTCAGCATT TC (SEQ ID NO: 288) |
| CAV1 | NM_001753.3 | AACCGCGACCCTAA ACACCTCAACGATG ACGTGGTCAAGATT GACTTTGAAGATGT GATTGCAGAACCA GAAGGGACACACA GTTTTGACGGCATT TGGA (SEQ ID NO: 289) | TCAAAGTCAATCT TGACCACGTCATC GTTGAGGTGTTTA GGGTCGCGGTT (SEQ ID NO: 290) | TCCAAATGCCGT CAAAACTGTGTG TCCCTTCTGGTT CTGCAATCACAT CT (SEQ ID NO: 291) |
| CAV2 | NM_198212.1 | GCCTTTTGTAAAGA CCTGCCTAATGGTT CTGCCTTCAGTGCA GACAATATGGAAG AGTGTGACAGATGT TATCATTGCTCCAT TGTGTACGAGCGTA GGA (SEQ ID NO: 292) | ATATTGTCTGCAC TGAAGGCAGAAC CATTAGGCAGGT CTTTACAAAAGG C (SEQ ID NO: 293) | TCCTACGCTCGT ACACAATGGAGC AATGATAACATC TGTCACACTCTT CC (SEQ ID NO: 294) |
| CCDC50 | NM_174908.3 | AAACACTTTCCAGA GTTCCCTGCAACCC GTGCTTATGCAGAT AGTTACTATTATGA AGATGGAGGAATG AAGCCAAGAGTGA TGAAAGAAGCTGT ATCTA (SEQ ID NO: 295) | TAGTAACTATCTG CATAAGCACGGG TTGCAGGGAACT CTGGAAAGTGTTT (SEQ ID NO: 296) | TAGATACAGCTT CTTTCATCACTC TTGGCTTCATTC CTCCATCTTCAT AA (SEQ ID NO: 297) |
| CCDC75 | NM_174931.2 | ACTTGGCAAGAGTG GGGGTGGTATTGTT GAACCAATTCCTCT CAATATCAAAACA GGGAAAAGTGGCA TTGGTCATGAGGCA TCATTAAAACGGAA AGCA (SEQ ID NO: 298) | TGATATTGAGAG GAATTGGTTCAA CAATACCACCCC CACTCTTGCCAAG T (SEQ ID NO: 299) | CTTTCCGTTTTA ATGATGCCTCAT GACCAATGCCAC TTTTCCCTGTTT (SEQ ID NO: 300) |
| CCL17 | NM_002987.2 | GCCTGGAGTACTTC AAGGGAGCCATTCC CCTTAGAAAGCTGA AGACGTGGTACCA GACATCTGAGGACT GCTCCAGGGATGCC ATCGTTTTGTAAC TGT (SEQ ID NO: 301) | CCACGTCTTCAGC TTTCTAAGGGGA ATGGCTCCCTTGA AGTACTC (SEQ ID NO: 302) | ACAGTTACAAAA ACGATGGCATCC CTGGAGCAGTCC TCAGATGTCTGG TA (SEQ ID NO: 303) |
| CCNA2 | NM_001237.2 | CGGGACAAAGCTG GCCTGAATCATTAA TACGAAAGACTGG ATATACCCTGGAAA GTCTTAAGCCTTGT CTCATGGACCTTCA CCAGACCTACCTCA AAGC (SEQ ID NO: 304) | CAGGGTATATCC AGTCTTTCGTATT AATGATTCAGGC CAGCTTTGTCCCG (SEQ ID NO: 305) | GCTTTGAGGTAG GTCTGGTGAAGG TCCATGAGACAA GGCTTAAGACTT TC (SEQ ID NO: 306) |
| CCNB1 | NM_031966.2 | AACTTGAGGAAGA GCAAGCAGTCAGA | TTCCCGACCCAGT AGGTATTTTGGTC | TGAACCTGTACT AGCCAGTCAATT |

TABLE 1-continued

| Gene | GenBank Accession No. | Target Sequence | Capture Probe Sequence | Reporter Probe Sequence |
|---|---|---|---|---|
| | | CCAAAATACCTACTGGGTCGGGAAGTCACTGGAAACATGAGAGCCATCCTAATTGACTGGCTAGTACAGGTTCA (SEQ ID NO: 307) | TGACTGCTTGCTCTTCCTCAAGTT (SEQ ID NO: 308) | AGGATGGCTCTCATGTTTCCAGTGAC (SEQ ID NO: 309) |
| CCNB2 | NM_004701.2 | AGGTTGATGTTGAACAGCACACTTTAGCCAAGTATTTGATGGAGCTGACTCTCATCGACTATGATATGGTGCATTATCATCCTTCTAAGGTAGCAGCAGC (SEQ ID NO: 310) | AGTCAGCTCCATCAAATACTTGGCTAAAGTGTGCTGTTCAACATCAACCT (SEQ ID NO: 311) | GCTGCTGCTACCTTAGAAGGATGATAATGCACCATATCATAGTCGATGAG (SEQ ID NO: 312) |
| CCND1 | NM_053056.2 | TTGAACACTTCCTCTCCAAAATGCCAGAGGCGGAGGAGAACAAACAGATCATCCGCAAACACGCGCAGACCTTCGTTGCCCTCTGTGCCACAGATGTGAA (SEQ ID NO: 313) | GATCTGTTTGTTCTCCTCCGCCTCTGGCATTTTGGAGAGGAAGTGTTCAA (SEQ ID NO: 314) | TTCACATCTGTGGCACAGAGGGCAACGAAGGTCTGCGCGTGTTTGCGGAT (SEQ ID NO: 315) |
| CCND2 | NM_001759.2 | AGCCTGCATCCCTTCGCCTGCAGCCTACTTTGGGGAAATAAAGTGCCTTACTGACTGTAGCCATTACAGTATCCAATGTCTTTTGACAGGTGCCTGTCCT (SEQ ID NO: 316) | TAAGGCACTTTATTTCCCCAAAGTAGGCTGCAGGCGAAGGGATGCAGGCT (SEQ ID NO: 317) | AGGACAGGCACCTGTCAAAAGACATTGGATACTGTAATGGCTACAGTCAG (SEQ ID NO: 318) |
| CCND3 | NM_001760.2 | GGCCAGCCATGTCTGCATTTCGGTGGCTAGTCAAGCTCCTCCTCCCTGCATCTGACCAGCAGCGCCTTTCCCAACTCTAGCTGGGGTGGGCCAGGCTGA (SEQ ID NO: 319) | TGCAGGGAGGAGGAGCTTGACTAGCCACCGAAATGCAGACATGG (SEQ ID NO: 320) | CCCAGCTAGAGTTGGGAAAGGCGCTGCTGGTCAGA (SEQ ID NO: 321) |
| CCR7 | NM_001838.2 | TTCCGAAAACCAGGCCTTATCTCCAAGACCAGAGATAGTGGGGAGACTTCTTGGCTTGGTGAGGAAAAGCGGACATCAGCTGGTCAAACAAACTCTCTGA (SEQ ID NO: 322) | GAAGTCTCCCCACTATCTCTGGTCTTGGAGATAAGGCCTGGTTTTCGGAA (SEQ ID NO: 323) | TCAGAGAGTTTGTTTGACCAGCTGATGTCCGCTTTTCCTCACCAAGCCAA (SEQ ID NO: 324) |
| CD2 | NM_001767.2 | TGGGTCTCACTACAAGCAGCCTATCTGCTTAAGAGACTCTGGAGTTTCTTATGTGCCCTGGTGGACACTTGCCCACCATCCTGTGAGTAAAAGTGAAATA (SEQ ID NO: 325) | AAGAAACTCCAGAGTCTCTTAAGCAGATAGGCTGCTTGTAGTGAGACCCA (SEQ ID NO: 326) | TATTTCACTTTTACTCACAGGATGGTGGGCAAGTGTCCACCAGGGCACAT (SEQ ID NO: 327) |
| CD200 | NM_005944.5 | CCCTCGGTCAGGGATTGAAAATAGTACAGTGACTCTGTCTCACCCAAATGGGACCACGTCTGTTACCAGCATCCTCCATATCAAAGACCCTAAGAATCAG (SEQ ID NO: 328) | CATTTGGGTGAGACAGAGTCACTGTACTATTTTCAATCCCTGACCGAGG (SEQ ID NO: 329) | CTGATTCTTAGGGTCTTTGATATGGAGGATGCTGGTAACAGACGTGGCC (SEQ ID NO: 330) |

TABLE 1-continued

| Gene | GenBank Accession No. | Target Sequence | Capture Probe Sequence | Reporter Probe Sequence |
|---|---|---|---|---|
| CD22 | NM_001771.2 | TTTTCCAGAAGATGAGGGGATTCATTACTCAGAGCTGATCCAGTTTGGGGTCGGGGAGCGGCCTCAGGCACAAGAAAATGTGGACTATGTGATCCTCAAA (SEQ ID NO: 331) | CCCCAAACTGGATCAGCTCTGAGTAATGAATCCCCTCATCTTCTGGAAAA (SEQ ID NO: 332) | TTTGAGGATCACATAGTCCACATTTTCTTGTGCCTGAGGCCGCTCCCCGA (SEQ ID NO: 333) |
| CD247 | NM_198053.1 | TGGCAGGACAGGAAAAACCCGTCAATGTACTAGGATACTGCTGCGTCATTACAGGGCACAGGCCATGGATGGAAAACGCTCTCTGCTCTGCTTTTTTTCT (SEQ ID NO: 334) | AATGACGCAGCAGTATCCTAGTACATTGACGGGTTTTTCCTGTCCTGCCA (SEQ ID NO: 335) | AGAAAAAAAGCAGAGCAGAGAGCGTTTTCCATCCATGGCCTGTGCCCTGT (SEQ ID NO: 336) |
| CD274 | NM_014143.2 | TAGGAGATTAGATCCTGAGGAAAACCATACAGCTGAATTGGTCATCCCAGAACTACCTCTGGCACATCCTCCAAATGAAAGGACTCACTTGGTAATTCTG (SEQ ID NO: 337) | CTGGGATGACCAATTCAGCTGTATGGTTTTCCTCAGGATCTAATCTCCTA (SEQ ID NO: 338) | CAGAATTACCAAGTGAGTCCTTTCATTTGGAGGATGTGCCAGAGGTAGTT (SEQ ID NO: 339) |
| CD3D | NM_000732.4 | TATCTACTGGATGAGTTCCGCTGGGAGATGGAACATAGCACGTTTCTCTCTGGCCTGGTACTGGCTACCCTTCTCTCGCAAGTGAGCCCCTTCAAGATAC (SEQ ID NO: 340) | GAGAGAAACGTGCTATGTTCCATCTCCCAGCGGAACTCATCCAGTAGATA (SEQ ID NO: 341) | TCACTTGCGAGAGAAGGGTAGCCAGTACCAGGCCA (SEQ ID NO: 342) |
| CD3E | NM_000733.2 | AAGTAACAGTCCCATGAAACAAAGATGCAGTCGGGCACTCACTGGAGAGTTCTGGGCCTCTGCCTCTTATCAGTTGGCGTTTGGGGGCAAGATGGTAATG (SEQ ID NO: 343) | ACTCTCCAGTGAGTGCCCGACTGCATCTTTGTTTCATGGGACTGTTACTT (SEQ ID NO: 344) | CATTACCATCTTGCCCCCAAACGCCAACTGATAAGAGGCAGAGGCCCAGA (SEQ ID NO: 345) |
| CD3G | NM_000073.2 | AGAGCTTCAGACAAGCAGACTCTGTTGCCCAATGACCAGCTCTACCAGCCCCTCAAGGATCGAGAAGATGACCAGTACAGCCACCTTCAAGGAAACCAGT (SEQ ID NO: 346) | GGCTGGTAGAGCTGGTCATTGGGCAACAGAGTCTG (SEQ ID NO: 347) | ACTGGTTTCCTTGAAGGTGGCTGTACTGGTCATCTTCTCGATCCTTGAGG (SEQ ID NO: 348) |
| CD40 | NM_001250.4 | CCCAGGAAGCCATATACACAGATGCCATTGCAGCATTGTTTGTGATAGTGAACAACTGGAAGCTGCTTAACTGTCCATCAGCAGGAGACTGGCTAAATA (SEQ ID NO: 349) | ACTATCACAAACAATGCTGCAATGGGCATCTGTGTATATGGCTTCCTGGG (SEQ ID NO: 350) | TATTTAGCCAGTCTCCTGCTGATGGACAGTTAAGCAGCTTCCAGTTGTTC (SEQ ID NO: 351) |
| CD44 | NM_000610.3 | GTGGGCAGAAGAAAAAGCTAGTGATCAACAGTGGCAATGGAGCTGTGGAGGACAGAAAGCCAAGTG | CTCCACAGCTCCATTGCCACTGTTGATCACTAGCTTTTTCTTCTGCCCAC (SEQ ID NO: 353) | CTGGCCTCTCCGTTGAGTCCATTGGCTTTCTGTC (SEQ ID NO: 354) |

TABLE 1-continued

| Gene | GenBank Accession No. | Target Sequence | Capture Probe Sequence | Reporter Probe Sequence |
|---|---|---|---|---|
| | | GACTCAACGGAGA GGCCAGCAAGTCTC AGGAAAT (SEQ ID NO: 352) | | |
| CD47 | NM_001777.3 | GCCATATTGGTTAT TCAGGTGATAGCCT ATATCCTCGCTGTG GTTGGACTGAGTCT CTGTATTGCGGCGT GTATACCAATGCAT GGCCCTCTTCTGAT TT (SEQ ID NO: 355) | AGTCCAACCACA GCGAGGATATAG GCTATCACCTGA ATAACCAATATG GC (SEQ ID NO: 356) | AAATCAGAAGA GGGCCATGCATT GGTATACACGCC GCAATACAGAG ACTC (SEQ ID NO: 357) |
| CD5 | NM_014207.2 | CCAGAAGAAGCAG CGCCAGTGGATTGG CCCAACGGGAATG AACCAAAACATGTC TTTCCATCGCAACC ACACGGCAACCGTC CGATCCCATGCTGA GAAC (SEQ ID NO: 358) | TGTTTTGGTTCAT TCCCGTTGGGCCA ATCCACTGGCGCT GCTTCTTCTGG (SEQ ID NO: 359) | GTTCTCAGCATG GGATCGGACGGT TGCCGTGTGGTT GCGATGGAAAG ACA (SEQ ID NO: 360) |
| CD58 | NM_001779.2 | GTGCTTGAGTCTCT TCCATCTCCCACAC TAACTTGTGCATTG ACTAATGGAAGCAT TGAAGTCCAATGCA TGATACCAGAGCAT TACAACAGCCATCG AG (SEQ ID NO: 361) | CCATTAGTCAATG CACAAGTTAGTG TGGGAGATGGAA GAGACTCAAGCA C (SEQ ID NO: 362) | CTCGATGGCTGT TGTAATGCTCTG GTATCATGCATT GGACTTCAATGC TT (SEQ ID NO: 363) |
| CD6 | NM_006725.3 | CGCTGGCAGCCAG GGTCCTCTGCTCAG CTTCCCGGAGTTTG CACAATCTGTCCAC TCCCGAAGTCCCTG CAAGTGTTCAGACA GTCACTATAGAATC TTC (SEQ ID NO: 364) | CAGATTGTGCAA ACTCCGGGAAGC TGAGCAGAGGAC CCTGGCTGC (SEQ ID NO: 365) | GAAGATTCTATA GTGACTGTCTGA ACACTTGCAGGG ACTTCGGGAGTG GA (SEQ ID NO: 366) |
| CD74 | NM_001025159.1 | TTCAGCCCCCAGCC CCTCCCCCATCTCC CACCCTGTACCTCA TCCCATGAGACCCT GGTGCCTGGCTCTT TCGTCACCCTTGGA CAAGACAAACCAA GTC (SEQ ID NO: 367) | TCATGGGATGAG GTACAGGGTGGG AGATGGGGAG (SEQ ID NO: 368) | TTGGTTTGTCTT GTCCAAGGGTGA CGAAAGAGCCA GGCACCAGGGTC (SEQ ID NO: 369) |
| CD79A | NM_001783.3 | AACGAGAAGCTCG GGTTGGATGCCGGG GATGAATATGAAG ATGAAAACCTTTAT GAAGGCCTGAACCT GGACGACTGCTCCA TGTATGAGGACATC TCCC (SEQ ID NO: 370) | AGGTTTTCATCTT CATATTCATCCCC GGCATCCAACCC GAGCTTCTCGTT (SEQ ID NO: 371) | CTCATACATGGA GCAGTCGTCCAG GTTCAGGCCTTC ATAA (SEQ ID NO: 372) |
| CD79B | NM_000626.2 | TACCGGAATCCCAA AGGTAGTGCTTGTT CGCGGATCTGGCAG AGCCCACGTTTCAT AGCCAGGAAACGG GGCTTCACGGTGAA AATGCACTGCTACA TGA (SEQ ID NO: 373) | CGTGGGCTCTGCC AGATCCGCGAAC AAGCACTACCTTT GGGATTCCG (SEQ ID NO: 374) | TCATGTAGCAGT GCATTTTCACCG TGAAGCCCCGTT TCCTGGCTATGA AA (SEQ ID NO: 375) |
| CD8A | NM_001768.5 | GCTCAGGGCTCTTT CCTCCACACCATTC | GGGGCCTCGGAA AGAAAGACCTGA | AAGTACTTGTTC CCTTGCCGTTGG |

TABLE 1-continued

| Gene | GenBank Accession No. | Target Sequence | Capture Probe Sequence | Reporter Probe Sequence |
|---|---|---|---|---|
| | | AGGTCTTTCTTTCC GAGGCCCCTGTCTC AGGGTGAGGTGCTT GAGTCTCCAACGGC AAGGGAACAAGTA CTT (SEQ ID NO: 376) | ATGGTGTGGAGG AAAGAGCCCTGA GC (SEQ ID NO: 377) | AGACTCAAGCAC CTCACCCTGAGA CA (SEQ ID NO: 378) |
| CD8B | NM_004931.3 | CAGCTGAGTGTGGT TGATTTCCTTCCCA CCACTGCCCAGCCC ACCAAGAAGTCCA CCCTCAAGAAGAG AGTGTGCCGGTTAC CCAGGCCAGAGAC CCAGA (SEQ ID NO: 379) | TTCTTGGTGGGCT GGGCAGTGGTGG GAAGGAAATCAA CCACACTCAG (SEQ ID NO: 380) | CCTGGGTAACCG GCACACTCTCTT CTTGAGGGTGGA C (SEQ ID NO: 381) |
| CDC20 | NM_001255.2 | GGAACATCAGAAA GCCTGGGCTTTGAA CCTGAACGGTTTTG ATGTAGAGGAAGC CAAGATCCTTCGGC TCAGTGGAAAACC ACAAAATGCGCCA GAGGGT (SEQ ID NO: 382) | CCTCTACATCAAA ACCGTTCAGGTTC AAAGCCCAGGCT TTCTGATGTTCC (SEQ ID NO: 383) | ACCCTCTGGCGC ATTTTGTGGTTTT CCACTGAGCCGA AGGATCTTGGCC T (SEQ ID NO: 384) |
| CDC25B | NM_021873.2 | CACCATACGAGCAC CTCCAGCCTGAACA GAAGCTCTTACTCT TTCCTATTTCAGTG TTACCTGTGTGCTT GGTCTGTTTGACTT TACGCCCATCTCAG GA (SEQ ID NO: 385) | AATAGGAAAGAG TAAGAGCTTCTGT TCAGGCTGGAGG TGCTCGTATGGTG (SEQ ID NO: 386) | TCCTGAGATGGG CGTAAAGTCAAA CAGACCAAGCAC ACAGGTAACACT GA (SEQ ID NO: 387) |
| CDC25C | NM_001790.2 | CTCTCTGTGTGACA TTACTATCACTCAG ATGCTGGAGGAAG ATTCTAACCAGGGG CACCTGATTGGTGA TTTTTCCAAGGTAT GTGCGCTGCCAACC GTG (SEQ ID NO: 388) | GGTTAGAATCTTC CTCCAGCATCTGA GTGATAGTAATG TCACACAGAGAG (SEQ ID NO: 389) | CACGGTTGGCAG CGCACATACCTT GGAAAAATCACC AATCAGGTGCCC CT (SEQ ID NO: 390) |
| CDCA3 | NM_031299.4 | AAGGAGCCATTCTT GGAACTGGACGAC TTCTGAAAACTGGA GGACGAGCATGGG AGCAAGGCCAGGA CCATGACAAGGAA AATCAGCACTTTCC CTTGGT (SEQ ID NO: 391) | TGCTCGTCCTCCA GTTTTCAGAAGTC GTCCAGTTCCAA GAATGGCT (SEQ ID NO: 392) | AAGGGAAAGTG CTGATTTTCCTT GTCATGGTCCTG GCCTTGCTCCCA (SEQ ID NO: 393) |
| CDCA5 | NM_080668.3 | TGCAGTCAGAAAG CCCATCGTCTTAAA GAGGATCGTGGCCC ATGCTGTAGAGGTC CCAGCTGTCCAATC ACCTCGCAGGAGCC CTAGGATTCCTTTT TTC (SEQ ID NO: 394) | CTACAGCATGGG CCACGATCCTCTT TAAGACGATGGG CTTTCTGAC (SEQ ID NO: 395) | GAAAAAGGAAA TCCTAGGGCTCC TGCGAGGTGATT GGACAGCTGGG ACCT (SEQ ID NO: 396) |
| CDCA8 | NM_018101.2 | TCCCTGTTTACTGA AGACCAAATACTG GTTTGGAGACAACT TCCATGTCTTGCTC TTCTACCTCCCTAG TTAGTGGAAATTTG GATAAGGGAACTG TAGG (SEQ ID NO: 397) | AGACATGGAAGT TGTCTCCAAACCA GTATTTGGTCTTC AGTAAACAGGGA (SEQ ID NO: 398) | CCTACAGTTCCC TTATCCAAATTT CCACTAACTAGG GAGGTAGAAGA GCA (SEQ ID NO: 399) |

TABLE 1-continued

| Gene | GenBank Accession No. | Target Sequence | Capture Probe Sequence | Reporter Probe Sequence |
|---|---|---|---|---|
| CDH11 | NM_001797.2 | CAGGAAGCCAAAGTCCCAGTGGCCATTAGGGTCCTTGATGTCAACGATAATGCTCCCAAGTTTGCTGCCCCTTATGAAGGTTTCATCTGTGAGAGTGATC (SEQ ID NO: 400) | TTATCGTTGACATCAAGGACCCTAATGGCCACTGGGACTTTGGCTTCCTG (SEQ ID NO: 401) | GATCACTCTCACAGATGAAACCTTCATAAGGGGCAGCAAACTTGGGAGCA (SEQ ID NO: 402) |
| CDK1 | NM_001786.2 | CACATGAGGTAGTAACACTCTGGTACAGATCTCCAGAAGTATTGCTGGGGTCAGCTCGTTACTCAACTCCAGTTGACATTTGGAGTATAGGCACCATATT (SEQ ID NO: 403) | CCCCAGCAATACTTCTGGAGATCTGTACCAGAGTGTTACTACCTCATGTG (SEQ ID NO: 404) | AATATGGTGCCTATACTCCAAATGTCAACTGGAGTTGAGTAACGAGCTGA (SEQ ID NO: 405) |
| CDK14 | NM_012395.2 | ATTACTCAGTGGACGGAGAAGTCTGTTTTGTTACAGAGACATGCCTCTCAGAAGGTCAGGAGGTTTTGAGTACCTATCCTTGCCACCCATACAGGAAATC (SEQ ID NO: 406) | TGAGAGGCATGTCTCTGTAACAAAACAGACTTCTCCGTCCACTGAGTAAT (SEQ ID NO: 407) | GATTTCCTGTATGGGTGGCAAGGATAGGTACTCAAAACCTCCTGACCTTC (SEQ ID NO: 408) |
| CDK4 | NM_000075.2 | ACTTTTAACCCACACAAGCGAATCTCTGCCTTTCGAGCTCTGCAGCACTCTTATCTACATAAGGATGAAGGTAATCCGGAGTGAGCAATGGAGTGGCTGC (SEQ ID NO: 409) | GAGTGCTGCAGAGCTCGAAAGGCAGAGATTCGCTTGTGTGGGTTAAAAGT (SEQ ID NO: 410) | GCAGCCACTCCATTGCTCACTCCGGATTACCTTCATCCTTATGTAGATAA (SEQ ID NO: 411) |
| CDK5RAP2 | NM_001011649.1 | AGCAACTGGAGCAGGATGTGCTTTCATATCAGAATTTGCGGAAGACCTTGGAGGAGCAGATCAGCGAAATTCGGAGGCGGGAAGAAGAATCATTTTCACT (SEQ ID NO: 412) | CAAGGTCTTCCGCAAATTCTGATATGAAAGCACATCCTGCTCCAGTTGCT (SEQ ID NO: 413) | AGTGAAAATGATTCTTCTTCCCGCCTCCGAATTTCGCTGATCTGCTCCTC (SEQ ID NO: 414) |
| CDK6 | NM_001259.5 | GGGAAAGAAAAGTGCAATGATTCTGGACTGAGACGCGCTTGGGCAGAGGCTATGTAATCGTGTCTGTGTTGAGGACTTCGCTTCGAGGAGGGAAGAGGAG (SEQ ID NO: 415) | GCCTCTGCCCAAGCGCGTCTCAGTCCAGAATCATTGCACTTTTCTTTC (SEQ ID NO: 416) | CTCCTCTTCCCTCCTCGAAGCGAAGTCCTCAACACAGACACGATTACATA (SEQ ID NO: 417) |
| CDKN3 | NM_005192.3 | TACCGAAAAACCTTAATACACTGCTATGGAGGACTTGGGAGATCTTGTCTTGTAGCTGCTTGTCTCCTACTATACCTGTCTGACACAATATCACCAGAGC (SEQ ID NO: 418) | AGACAAGATCTCCCAAGTCCTCCATAGCAGTGTATTAAGGTTTTTCGGTA (SEQ ID NO: 419) | CTCTGGTGATATTGTGTCAGACAGGTATAGTAGGAGACAAGCAGCTACA (SEQ ID NO: 420) |
| CELSR1 | NM_014246.1 | CCTGGGACCTTAAAGCGTTGCAGGTTCC | CCCCACACCTCTGTCCAAATCAGGA | AGTCTCAGAGAGTTAGAGAATTGG |

TABLE 1-continued

| Gene | GenBank Accession No. | Target Sequence | Capture Probe Sequence | Reporter Probe Sequence |
|---|---|---|---|---|
| | | TGATTTGGACAGAGGTGTGGGGCCTTCCAGGCCGTTACATACCTCCTGCCAATTCTCTAACTCTCTGAGACT (SEQ ID NO: 421) | ACCTGCAACGCTTTAAGGTCC (SEQ ID NO: 422) | CAGGAGGTATGTAACGGCCTGGAAGG (SEQ ID NO: 423) |
| CENPA | NM_001042426.1 | CACTTTGAGCAGTTGCCTGGAAGGCTGGGCATTTCCATCATATAGACCTCTGCCCTTCAGAGTAGCCTCACCATTAGTGGCAGCATCATGTAACTGAGTG (SEQ ID NO: 424) | GAGGTCTATATGATGGAAATGCCCAGCCTTCCAGGCAACTGCTCAAAGTG (SEQ ID NO: 425) | CACTCAGTTACATGATGCTGCCACTAATGGTGAGGCTACTCTGAAGGGCA (SEQ ID NO: 426) |
| CENPE | NM_001813.2 | GCACCAATCATCGATTCTGCCATACAAGGCTACAATGGTACTATATTTGCCTATGGACAGACTGCTTCAGGAAAAACATATACCATGATGGGTTCAGAAG (SEQ ID NO: 427) | GCAAATATAGTACCATTGTAGCCTTGTATGGCAGAATCGATGATTGGTGC (SEQ ID NO: 428) | CTTCTGAACCCATCATGGTATATGTTTTTCCTGAAGCAGTCTGTCCATAG (SEQ ID NO: 429) |
| CENPF | NM_016343.3 | AGATAATGTGGCCAAGGTGAATGACAGCTGGAAGGAGAGATTTCTTGATGTGGAAAATGAGCTGAGTAGGATCAGATCGGAGAAAGCTAGCATTGAGCAT (SEQ ID NO: 430) | CATCAAGAAATCTCTCCTTCCAGCTGTCATTCACCTTGGCCACATTATCT (SEQ ID NO: 431) | ATGCTCAATGCTAGCTTTCTCCGATCTGATCCTACTCAGCTCATTTTCCA (SEQ ID NO: 432) |
| CENPN | NM_018455.3 | CTCCCAGACTCCGTACGCCTTCACGTCCTCCTCCATGCTGAGGCGCAATACACCGCTTCTGGGTCAGGAGTTAGAAGCTACTGGGAAAATCTACCTCCGA (SEQ ID NO: 433) | TATTGCGCCTCAGCATGGAGGAGGACGTGAAGGCGTACGGAG (SEQ ID NO: 434) | TCGGAGGTAGATTTTCCCAGTAGCTTCTAACTCCTGACCCAGAAGCGGTG (SEQ ID NO: 435) |
| CENPV | NM_181716.2 | TTCATTGTTCCAGCTTCTCGCTTCAAGCTCCTGAAGGGAGCTGAGCACATAACGACTTACACGTTCAATACTCACAAAGCCCAGCATACCTTCTGTAAGA (SEQ ID NO: 436) | ATGTGCTCAGCTCCCTTCAGGAGCTTGAAGCGAGAAGCTGGAACAATGAA (SEQ ID NO: 437) | TCTTACAGAAGGTATGCTGGGCTTTGTGAGTATTGAACGTGTAAGTCGTT (SEQ ID NO: 438) |
| CEP55 | NM_018131.4 | CTGCCCGCTCTGATAACAGTCCTTTTCCCTGGCGCTCACTTCGTGCCTGGCACCCGGCTGGGCGCCTCAAGACCGTTGTCTCTTCGATCGCTTCTTTGA (SEQ ID NO: 439) | CCAGGCACGAAGTGAGCGCCAGGGAAAAGGACTGTTATCAGAGCGGG (SEQ ID NO: 440) | TCCAAAGAAGCGATCGAAGAGACAACGGTCTTGAGGCGCCCAGCCGGGTG (SEQ ID NO: 441) |
| CFLAR | NM_003879.3 | CAAGACCCTTGTGAGCTTCCCTAGTCTAAGAGTAGGATGTCTGCTGAAGTCATCCATCAGGTTGAAGAAGCACTTGATACAGATGAGAAGGAGATGCTGC (SEQ ID NO: 442) | ACTTCAGCAGACATCCTACTCTTAGACTAGGGAAGCTCACAAGGGTCTTG (SEQ ID NO: 443) | GCAGCATCTCCTTCTCATCTGTATCAAGTGCTTCTTCAACCTGATGGATG (SEQ ID NO: 444) |

TABLE 1-continued

| Gene | GenBank Accession No. | Target Sequence | Capture Probe Sequence | Reporter Probe Sequence |
| --- | --- | --- | --- | --- |
| CGNL1 | NM_032866.3 | TGAACCATGGAGCTGTATTCGGTGAATATCAACATGTGCAGCAGGAATATGGGGTCCATCTGAGACTCGCAAGTGATGATACCCAAAAATCAAGGAGTT (SEQ ID NO: 445) | TATTCCTGCTGCACATGTTGATATTCACCGAAATACAGCTCCATGGTTCA (SEQ ID NO: 446) | CTTGATTTTTGGGTATCATCACTTGCGAGTCTCAGATGGACCCCA (SEQ ID NO: 447) |
| CHD4 | NM_001273.2 | AGAGGCATCTGTGAAATTCCATGTGCTGCTGACATCCTATGAATTGATCACCATTGACATGGCTATTTTGGGCTCTATTGATTGGGCCTGCCTCATCGTG (SEQ ID NO: 448) | TGATCAATTCATAGGATGTCAGCAGCACATGGAATTTCACAGATGCCTCT (SEQ ID NO: 449) | CACGATGAGGCAGGCCCAATCAATAGAGCCCAAAATAGCCATGTCAATGG (SEQ ID NO: 450) |
| CHST5 | NM_012126.1 | TAGGAGGCTGAGGTGGGAGAATCACTTGGACTCCAAAGGTGGAGGTTGCAGTAAGCTGAAATCATGCCACTGCACCCTAGCTTGGGTGGCAAAGCAAAAC (SEQ ID NO: 451) | TGCAACCTCCACCTTTGGAGTCCAAGTGATTCTCCCAC (SEQ ID NO: 452) | CACCCAAGCTAGGGTGCAGTGGCATGATTTCAGCTTAC (SEQ ID NO: 453) |
| CIITA | NM_000246.3 | GCCTGAGCAAGGACATTTTCAAGCACATAGGACCAGATGAAGTGATCGGTGAGAGTATGGAGATGCCAGCAGAAGTTGGGCAGAAAAGTCAGAAAAGACC (SEQ ID NO: 454) | ACCGATCACTTCATCTGGTCCTATGTGCTTGAAAATGTCCTTGCTCAGGC (SEQ ID NO: 455) | GGTCTTTTCTGACTTTTCTGCCCAACTTCTGCTGGCATCTCCATACTCTC (SEQ ID NO: 456) |
| CKS2 | NM_001827.1 | AAACTCATCTGATGTCTGAAGAGGAGTGGAGGAGACTTGGTGTCCAACAGAGTCTAGGCTGGGTTCATTACATGATTCATGAGCCAGAACCACATATTCT (SEQ ID NO: 457) | CTGTTGGACACCAAGTCTCCTCCACTCCTCTTCAGACATCAGATGAGTTT (SEQ ID NO: 458) | AGAATATGTGGTTCTGGCTCATGAATCATGTAATGAACCCAGCCTAGACT (SEQ ID NO: 459) |
| CLIP2 | NM_003388.4 | GTCCCTGTTGGCTTTCGGTAGCTCTCGCATGCAGTTCTATTAACAGCCGTCTAGAAGCGATGCTTTAGTGGCCTAACCCAGGGTCAAATACAGCTCTTTC (SEQ ID NO: 460) | ACGGCTGTTAATAGAACTGCATGCGAGAGCTACCGAAAGCCAACAGGGAC (SEQ ID NO: 461) | GAAAGAGCTGTATTTGACCCTGGGTTAGGCCACTAAAGCATCGCTTCTAG (SEQ ID NO: 462) |
| CLMN | NM_024734.3 | TACTCAAAACTCAGGCATGCAGCTGGATCCGTAGGTGGGGTTTTGTCCTTGTGTGCCTTGCTGGGTTGGATAGGGAGCATTGTTAGTGATCATTAGCCCG (SEQ ID NO: 463) | AAGGACAAAACCCCACCTACGGATCCAGCTGCATGCCTGAGTTTTGAGTA (SEQ ID NO: 464) | CGGGCTAATGATCACTAACAATGCTCCCTATCCAACCCAGCAAGGCACAC (SEQ ID NO: 465) |
| CPA6 | NM_001127445.1 | GCAGACGATCACGACTCAAAAGAGCT | ATGAATACCACAGTCTATCCAAAC | GCTTCTTTTACAAACCACTGACAA |

TABLE 1-continued

| Gene | GenBank Accession No. | Target Sequence | Capture Probe Sequence | Reporter Probe Sequence |
|---|---|---|---|---|
| | | GTTTGGATAGACTG TGGTATTCATGCAA GAGAATGGATTGGT CCTGCCTTTTGTCA GTGGTTTGTAAAAG AAGC (SEQ ID NO: 466) | AGCTCTTTTGAGT CGTGATCGTCTGC (SEQ ID NO: 467) | AAGGCAGGACC AATCCATTCTCT TGC (SEQ ID NO: 468) |
| CPNE3 | NM_003909.2 | GACTGCTCTCTGGT CTGTGGGACTGGTC ATTCAAGATTATGA TGCTGATAAGATGT TTCCAGCTTTTGGT TTTGGCGCTCAGAT ACCTCCTCAGTGGC AG (SEQ ID NO: 469) | TATCAGCATCATA ATCTTGAATGACC AGTCCCACAGAC CAGAGAGCAGTC (SEQ ID NO: 470) | CTGCCACTGAGG AGGTATCTGAGC GCCAAAACCAA AAGCTGGAAAC ATCT (SEQ ID NO: 471) |
| CR2 | NM_001006658.1 | GGTGTCAAGCAAAT AATATGTGGGGGCC GACACGACTACCA ACCTGTGTAAGTGT TTTCCCTCTCGAGT GTCCAGCACTTCCT ATGATCCACAATGG ACA (SEQ ID NO: 472) | TACACAGGTTGG TAGTCGTGTCGGC CCCCACATATTAT TTGCTTGACACC (SEQ ID NO: 473) | TGTCCATTGTGG ATCATAGGAAGT GCTGGACACTCG AGAGGGAAAAC ACT (SEQ ID NO: 474) |
| CREB3L2 | NM_194071.2 | ATGCCTGAGGGGAT CAGGCTTTTCTACT CCAGGCAAACCTGC CCCATCTTGTCGCT TTTAGGACCTCCCA CAACCTGGTTCCCC ACACATCCATAGTT CT (SEQ ID NO: 475) | AAGATGGGGCAG GTTTGCCTGGAGT AGAAAAGCCTGA TCCCCT (SEQ ID NO: 476) | AGAACTATGGAT GTGTGGGGAACC AGGTTGTGGGAG GTCCTAAAAGCG AC (SEQ ID NO: 477) |
| CREBBP | NM_004380.2 | CACATTCGAGGCTC ACAGGTGATTGTCG CTCACACAGTTAGG GTCGTCAGTTGGTC TGAAACTGCATTTG GCCCACTCCTCCAT CCTCCCTGTCCGTC GT (SEQ ID NO: 478) | CTGACGACCCTA ACTGTGTGAGCG ACAATCACCTGT GAGCCTCGAATG TG (SEQ ID NO: 479) | ACGACGGACAG GGAGGATGGAG GAGTGGGCCAA ATGCAGTTTCAG ACCAA (SEQ ID NO: 480) |
| CSF2RA | NM_006140.3 | AGAAGGAGGGAGA TCCGGTGTCCTTAT TACATACAAGACTC AGGAACCCATGTG GGATGTCACCTGGA TAACCTGTCAGGAT TAACGTCTCGCAAT TACT (SEQ ID NO: 481) | TGGGTTCCTGAGT CTTGTATGTAATA AGGACACCGGAT CTCCCTCCTT (SEQ ID NO: 482) | AGTAATTGCGAG ACGTTAATCCTG ACAGGTTATCCA GGTGACATCCCA CA (SEQ ID NO: 483) |
| CSTA | NM_005213.3 | CTTCCCGGACAAAA TGAGGACTTGGTAC TTACTGGATACCAG GTTGACAAAAACA AGGATGACGAGCT GACGGGCTTTTAGC AGCATGTACCCAAA GTGT (SEQ ID NO: 484) | TTGTCAACCTGGT ATCCAGTAAGTA CCAAGTCCTCATT TTGTCCGGGAAG (SEQ ID NO: 485) | ACACTTTGGGTA CATGCTGCTAAA AGCCCGTCAGCT CGTCATCCTTGT TT (SEQ ID NO: 486) |
| CTGF | NM_001901.2 | ACCACCCTGCCGGT GGAGTTCAAGTGCC | TTCTTCATGACCT CGCCGTCAGGGC | CTCCGGGACAGT TGTAATGGCAGG |

TABLE 1-continued

| Gene | GenBank Accession No. | Target Sequence | Capture Probe Sequence | Reporter Probe Sequence |
|---|---|---|---|---|
| | | CTGACGGCGAGGTC ATGAAGAAGAACA TGATGTTCATCAAG ACCTGTGCCTGCCA TTACAACTGTCCCG GAG (SEQ ID NO: 487) | ACTTGAACTCCAC CGG (SEQ ID NO: 488) | CACAGGTCTTGA TGAACATCATGT TC (SEQ ID NO: 489) |
| CTH | NM_001902.4 | CTCGCCGTCGGCTC TACCTGCGTGCTTT AGCTCCTTCTCGCC TGATCCTTCTGTCT CTCCCAACCCCGGA CACCCGGCTTCGAC TGGTTATATCTTCG GT (SEQ ID NO: 490) | AAGGATCAGGCG AGAAGGAGCTAA AGCACGCAGGTA GAGCCGACGGCG AG (SEQ ID NO: 491) | ACCGAAGATATA ACCAGTCGAAGC CGGGTGTCCGGG GTTGGGAGAGAC AG (SEQ ID NO: 492) |
| CTHRC1 | NM_138455.2 | CTGTGGAAGGACTT TGTGAAGGAATTGG TGCTGGATTAGTGG ATGTTGCTATCTGG GTTGGCACTTGTTC AGATTACCCAAAA GGAGATGCTTCTAC TGG (SEQ ID NO: 493) | AGCAACATCCAC TAATCCAGCACC AATTCCTTCACAA AGTCCTTCCACAG (SEQ ID NO: 494) | CCAGTAGAAGCA TCTCCTTTTGGG TAATCTGAACAA GTGCCAACCCAG AT (SEQ ID NO: 495) |
| CTLA4 | NM_005214.3 | AGTCTGTGCGGCAA CCTACATGATGGGG AATGAGTTGACCTT CCTAGATGATTCCA TCTGCACGGGCACC TCCAGTGGAAATCA AGTGAACCTCACTA TC (SEQ ID NO: 496) | CATCTAGGAAGG TCAACTCATTCC CATCATGTAGGTT GCCGC (SEQ ID NO: 497) | GATAGTGAGGTT CACTTGATTTCC ACTGGAGGTGCC CGTGCAGATGGA AT (SEQ ID NO: 498) |
| CTNNA2 | NM_004389.2 | GAACCATGATTTTG CTAGAAATAGAAG GCCCAGTGGTGGA ATATTAGAGGGAA GGAAACTGACAAC GTGTGAAAGTTAGA GGCAAATACATAG GTGTAGC (SEQ ID NO: 499) | CCTCTAATATTCC ACCACTGGGCCTT CTATTTCTAGCAA AATCATGGTTC (SEQ ID NO: 500) | CTACACCTATGT ATTTGCCTCTAA CTTTCACACGTT GTCAGTTTCCTT C (SEQ ID NO: 501) |
| CTPS | NM_001905.2 | CACCTTGTTTCTCA ACTACCTCGCATCA TTGCAGATGCTAGC GCGTTGCCTGTCGC TTTTCCCTTGGATAC CTAGACCGTTATAA AGTGTGCCACATGG AC (SEQ ID NO: 502) | GGCAACGCGCTA GCATCTGCAATG ATGCGAGGTAGT TGAGAAACAAGG TG (SEQ ID NO: 503) | GTCCATGTGGCA CACTTTATAACG GTCTAGGTATCC AAGGGAAAGCG ACA (SEQ ID NO: 504) |
| CTSH | NM_148979.2 | ACCCTGTGAGCTTT GCCTTTGAGGTGAC TCAGGACTTCATGA TGTATAGAACGGGC ATCTACTCCAGTAC TTCCTGCCATAAAA CTCCAGATAAAGTA AA (SEQ ID NO: 505) | TCTATACATCATG AAGTCCTGAGTC ACCTCAAAGGCA AAGCTCACAGGG T (SEQ ID NO: 506) | TTTACTTTATCTG GAGTTTTATGGC AGGAAGTACTGG AGTAGATGCCCG T (SEQ ID NO: 507) |
| CTSK | NM_000396.2 | TCTCATTCCCGCAG TAATGACACCCTTT ATATCCCAGAATGG GAAGGTAGAGCCC CAGACTCTGTCGAC TATCGAAAGAAAG GATATGTTACTCCT GTCA (SEQ ID NO: 508) | CTACCTTCCCATT CTGGGATATAAA GGGTGTCATTACT GCGGGAATGAGA (SEQ ID NO: 509) | TGACAGGAGTAA CATATCCTTTCTT TCGATAGTCGAC AGAGTCTGGGGC T (SEQ ID NO: 510) |

TABLE 1-continued

| Gene | GenBank Accession No. | Target Sequence | Capture Probe Sequence | Reporter Probe Sequence |
|---|---|---|---|---|
| CXCL10 | NM_001565.1 | GCAGAGGAACCTCCAGTCTCAGCACCATGAATCAAACTGCGATTCTGATTTGCTGCCTTATCTTTCTGACTCTAAGTGGCATTCAAGGAGTACCTCTCTC (SEQ ID NO: 511) | AATCAGAATCGCAGTTTGATTCATGGTGCTGAGACTGGAGGTTCCTCTGC (SEQ ID NO: 512) | GAGAGAGGTACTCCTTGAATGCCACTTAGAGTCAGAAAGATAAGGCAGCA (SEQ ID NO: 513) |
| CXCL12 | NM_199168.2 | GGGCCTGAGGTTTGCCAGCATTTAGACCCTGCATTTATAGCATACGGTATGATATTGCAGCTTATATTCATCCATGCCCTGTACCTGTGCACGTTGGAAC (SEQ ID NO: 514) | ATACCGTATGCTATAAATGCAGGGTCTAAATGCTGGCAAACCTCAGGCCC (SEQ ID NO: 515) | GTTCCAACGTGCACAGGTACAGGGCATGGATGAATATAAGCTGCAATATC (SEQ ID NO: 516) |
| CXCL9 | NM_002416.1 | CACCATCTCCCATGAAGAAAGGGAACGGTGAAGTACTAAGCGCTAGAGGAAGCAGCCAAGTCGGTTAGTGGAAGCATGATTGGTGCCCAGTTAGCCTCTG (SEQ ID NO: 517) | TCCTCTAGCGCTTAGTACTTCACCGTTCCCTTTCTTCATGGGAGATGGTG (SEQ ID NO: 518) | GCTAACTGGGCACCAATCATGCTTCCACTAACCGACTTGGCTGCT (SEQ ID NO: 519) |
| CYB5R2 | NM_016229.3 | CCATGTCTTAGGGCTTCCTGTAGGTAACTATGTCCAGCTCTTGGCAAAAATCGATAATGAATTGGTGGTCAGGGCTTACACCCCTGTCTCCAGTGATGAT (SEQ ID NO: 520) | TTTTTGCCAAGAGCTGGACATAGTTACCTACAGGAAGCCCTAAGACATGG (SEQ ID NO: 521) | ATCATCACTGGAGACAGGGGTGTAAGCCCTGACCACCAATTCATTATCGA (SEQ ID NO: 522) |
| CYP27A1 | NM_000784.3 | TTTGCTACATCCTGTTCGAGAAACGCATTGGCTGCCTGCAGCGATCCATCCCCGAGGACACCGTGACCTTCGTCAGATCCATCGGGTTAATGTTCCAGAA (SEQ ID NO: 523) | GATGGATCGCTGCAGGCAGCCAATGCGTTTCTCGAACAGGATGTAGCAAA (SEQ ID NO: 524) | TTCTGGAACATTAACCCGATGGATCTGACGAAGGTCACGGTGTCCTCGGG (SEQ ID NO: 525) |
| CYP2J2 | NM_000775.2 | GAAAAATGGATTGATTATGTCAAGTGGCCAGGCATGGAAGGAGCAAAGAAGGTTCACTCTGACAGCACTAAGGAACTTTGGTTTAGGAAAGAAGAGCTTA (SEQ ID NO: 526) | TTCTTTGCTCCTTCCATGCCTGGCCACTTGACATAATCAATCCAT (SEQ ID NO: 527) | TAAGCTCTTCTTTCCTAAACCAAAGTTCCTTAGTGCTGTCAGAGTGAACC (SEQ ID NO: 528) |
| CYSLTR1 | NM_006639.2.2 | AAAGAAGCTTGCCTATAGAGCAGGCACTCTGTGAATGGACTGTGCTTTTACGACCCTACAGGGTATCAAGATACTGTGCAGCTCGCCAACAAGGATAAT (SEQ ID NO: 529) | TAAAAGCACAGTCCATTCACAGAGTGCCTGCTCTATAGGCAAGCTTCTTT (SEQ ID NO: 530) | ATTAATCCTTGTTGGCGAGCTGCACAGTATCTTGATACCCTGTAGGGTCG (SEQ ID NO: 531) |
| DAZAP2 | NM_014764.3 | ATGCCATTACTTCTGCTTTCGTATCTCC | GGCACCCTCCACTTTTGCCTGAGGA | TTTGGGTTAGGTTCGTGTATGCAG |

TABLE 1-continued

| Gene | GenBank Accession No. | Target Sequence | Capture Probe Sequence | Reporter Probe Sequence |
|---|---|---|---|---|
| | | TCAGGCAAAAGTGGAGGGTGCCTTATGGGCCCTCCTCATAGGTTGTCTCTGCATACACGAACCTAACCCAAA (SEQ ID NO: 532) | GATACGAAAGCAGAAGTAATGGCAT (SEQ ID NO: 533) | AGACAACCTATGAGGAGGGCCCATAA (SEQ ID NO: 534) |
| DCBLD1 | NM_173674.1 | CTCTTGTTGAACACAAGTGAAGTAACCGTCCGCTTTGAGAGTGGATCCCACATTTCTGGCCGGGGTTTTTTGCTGACCTATGCGAGCAGCGACCATCCAG (SEQ ID NO: 535) | TGGGATCCACTCTCAAAGCGGACGGTTACTTCACTTGTGTTCAACAAGAG (SEQ ID NO: 536) | CTGGATGGTCGCTGCTCGCATAGGTCAGCAAAAAACCCCGGCCAGAAATG (SEQ ID NO: 537) |
| DCLK3 | NM_033403.1 | GAAAAAGCCATGTATGTCTGGAGGCAGAAGGATGACTCTCAGAGATGACCAACCTGCAAAGCTAGAAAAGGAGCCCAAGACGAGGCCAGAAGAGAACAAG (SEQ ID NO: 538) | GGTCATCTCTGAGAGTCATCCTTCTGCCTCCAGACATACATGGCTTTTTC (SEQ ID NO: 539) | CTTGTTCTCTTCTGGCCTCGTCTTGGGCTCCTTTTCTAGCTTTGCAGGTT (SEQ ID NO: 540) |
| DCTD | NM_001012732.1 | GATCCGGCAGCCTCTCTTCACTGCTACATGTGCTGGAAGGACAAATAAATAATTGTGGTTGTGTTCTTAATGGGGACGAGCAGACACACTGATCTGAACA (SEQ ID NO: 541) | ATTTATTTGTCCTTCCAGCACATGAGCAGTGAAGAGAGGCTGCCGGATC (SEQ ID NO: 542) | TGTTCAGATCAGTGTGTCTGCTCGTCCCCATTAAGAACACAACCACAATT (SEQ ID NO: 543) |
| DDAH2 | NM_013974.1 | CGACAGGAGTGGGGGTGGCCGCTGGAGACAGGTGAAGAAACAAGAAAACTAAGAAATCCGAGCGGTTGGAGGGGGAGTCTGTGTGGATGGGATGGGGACG (SEQ ID NO: 544) | AGTTTTCTTGTTTCTTCACCTGTCTCCAGCGGCCACCCC (SEQ ID NO: 545) | CATCCACACAGACTCCCCCTCCAACCCGCTCGGATTTCTT (SEQ ID NO: 546) |
| DENND4A | NM_005848.3 | TGATTTTCCCTTTCCACTGGCCATGCCCGTATGTTCCTCTCTGCCCACTGGCTTTAGCAGATGTCTTGAGTGCACCATGTCCATTCATAGTAGGGATTGA (SEQ ID NO: 547) | CAGTGGGCAGAGAGGAACATACGGGCATGGCCAGTGGAAAGGGAAAATCA (SEQ ID NO: 548) | TCAATCCCTACTATGAATGGACATGGTGCACTCAAGACATCTGCTAAAGC (SEQ ID NO: 549) |
| DLC1 | NM_182643.1 | TGACCCACTGGATGGACAGCCTTTTAATTCTGATGATCGTAACACAGCATGTCATCATGGACTAGTAGCTGACAGCTTGCAGGCAAGTATGGAAAAAGA (SEQ ID NO: 550) | TGCTGTGTTACGATCATCAGAATTAAAAGGCTGTCCCATCCAGTGGGTCA (SEQ ID NO: 551) | TCTTTTTCCATACTTGCCTGCAAGCTGTCAGCTACTAGTCCATGATGACA (SEQ ID NO: 552) |
| DLEU1 | XR_001515.1 | CATCGTGGTGCACGGCTCTCCCTTTGCTTCTTCGGTTGCAGTCCTCTTGCTTCTTGCGCGTGCGTGTAGCGCTTTTGCAAAGCCGCGGAGGTGAAGTGAA (SEQ ID NO: 553) | GCAAGAGGACTGCAACCGAAGAAGCAAAGGGAGAGCCGTGCACCACGATG (SEQ ID NO: 554) | TTCACTTCACCTCCGCGGCTTTGCAAAAGGCGCTACACGCACGCGCAAGAA (SEQ ID NO: 555) |

TABLE 1-continued

| Gene | GenBank Accession No. | Target Sequence | Capture Probe Sequence | Reporter Probe Sequence |
|---|---|---|---|---|
| DLGAP5 | NM_014750.3 | CCTGCTTCGGAGTC GGCGGTGGTCGTCC AGACCGAGTGTTCT TTACTTTTTGTTTGG TTGAGGTTTCACGC TAGAAGGTGGCTCA GGATGTCTTCATCA C (SEQ ID NO: 556) | AAAAGTAAAG AA CACTCGGTCTGG ACGACCACCGCC GACTCCGAAGCA GG (SEQ ID NO: 557) | GTGATGAAGACA TCCTGAGCCACC TTCTAGCGTGAA ACCTCAACCAAA CA (SEQ ID NO: 558) |
| DNAJA1 | NM_001539.2 | CATCATCCCAGAGG TGGTGTTCAGTGTC AGACCTCTTAATGG GCCAGTGAATAAC ACTCACTGCTGGCA TTTAATGTGCAGTA GTGAATGAGTGAA GGAC (SEQ ID NO: 559) | TCACTGGCCCATT AAGAGGTCTGAC ACTGAACACCAC CTCTGGGATGAT G (SEQ ID NO: 560) | GTCCTTCACTCA TTCACTACTGCA CATTAAATGCCA GCAGTGAGTGTT AT (SEQ ID NO: 561) |
| DNAJB12 | NM_017626.4 | TTTCTTCCATGTTTT AGAAAATGAGGCC TGTTTGGGGAAGGT ACCCTGGTGATGTT TTTGCTAGACATTA GCTGTAGCTGACAG CATAAGGAGAGTC GCA (SEQ ID NO: 562) | ACCAGGGTACCT TCCCCAAACAGG CCTCATTTTCTAA AACATGGAAGAA A (SEQ ID NO: 563) | TGCGACTCTCCT TATGCTGTCAGC TACAGCTAATGT CTAGCAAAAACA TC (SEQ ID NO: 564) |
| DNAJB9 | NM_012328.1 | GCCCGGATGCTGAA GCAAAATTCAGAG AGATTGCAGAAGC ATATGAAACACTCT CAGATGCTAATAGA CGAAAAGAGTATG ATACACTTGGACAC AGTGC (SEQ ID NO: 565) | TGTTTCATATGCT TCTGCAATCTCTC TGAATTTTGCTTC AGCATCCGGGC (SEQ ID NO: 566) | GCACTGTGTCCA AGTGTATCATAC TCTTTTCGTCTAT TAGCATCTGAGA G (SEQ ID NO: 567) |
| DNAJC10 | NM_018981.1 | AGGAGATTGTTTGA CTTCACAGACACGA CTCAGGCTTAGTGG CATGTTGGATGGTC TTGTTAATGTAGGA TGGATGGACTGTGC CACCCAGGATAACC TT (SEQ ID NO: 568) | CCAACATGCCAC TAAGCCTGAGTC GTGTCTGTGAAGT CAAACAATCTCCT (SEQ ID NO: 569) | AAGGTTATCCTG GGTGGCACAGTC CATCCATCCTAC ATTAACAAGACC AT (SEQ ID NO: 570) |
| DNMT3A | NM_175630.1 | TGGCAACAGCGGG CTTTCATAACGCCA ACGATTGCTAGACT GGGATAATGGCGG TCCCTCCATCGCCT TCTGTGGCTGGTTG TGGGCCTTAGTTTT CTGC (SEQ ID NO: 571) | CATTATCCCAGTC TAGCAATCGTTG GCGTTATGAAAG CCCGCTGTTG (SEQ ID NO: 572) | GCAGAAAACTA AGGCCCACAACC AGCCACAGAAG GCGATGGAGGG ACCGC (SEQ ID NO: 573) |
| DOCK10 | NM_014689.1 | CTGAGCTTAATCAG CTTTGCACAATGGA AGAAGTGGACATG ATCAGACTGCAGCT CAAACTGCGAGGA AGTGTCAGCGTGAA GGTTAATGCTGGGC CAAT (SEQ ID NO: 574) | CAGTCTGATCATG TCCACTTCTTCCA TTGTGCAAAGCT GATTAAGCTCAG (SEQ ID NO: 575) | ATTGGCCCAGCA TTAACCTTCACG CTGACACTTCCT CGCAGTTTGAGC TG (SEQ ID NO: 576) |
| DPY19L1 | NM_015283.1 | TTGTGGATTGTCCT TCAGACCTTAGTCC TCAGGCATGGTTTC TGGTGCCCACTCCT GGAAGCCGCTGTTC CCTTTCTACCTTCTT ACCAGAGCCCAAG GG (SEQ ID NO: 577) | GGGCACCAGAAA CCATGCCTGAGG ACTAAGGTCTGA AGGACAATCCAC AA (SEQ ID NO: 578) | CTTGGGCTCTGG TAAGAAGGTAG AAAGGGAACAG CGGCTTCCAGGA GT (SEQ ID NO: 579) |

TABLE 1-continued

| Gene | GenBank Accession No. | Target Sequence | Capture Probe Sequence | Reporter Probe Sequence |
|------|----------------------|-----------------|------------------------|-------------------------|
| DPYSL3 | NM_001387.2 | CCCTGGGCAGCCAGCATTCATTGTAAGTTCCCTCTTTGAAAACTGGTGTGTGGGTGTTCAGTTCTGTGTCTGGTGGGTATGGACAGACAGTAATCTCCTG (SEQ ID NO: 580) | CACACCAGTTTTCAAAGAGGGAACTTACAATGAATGCTGGCTGCCCAGGG (SEQ ID NO: 581) | CAGGAGATTACTGTCTGTCCATACCCACCAGACACAGAACTGAACACCCA (SEQ ID NO: 582) |
| DRAM1 | NM_018370.2 | GTCTTTAGTGCTTGGATTGGTGGGATGTTTCGGAATGGGCATTGTCGCCAATTTTCAGGAGTTAGCTGTGCCAGTGGTTCATGACGGGGGCGCTCTTTTG (SEQ ID NO: 583) | TGGCGACAATGCCCATTCCGAAACATCCCACCAATCCAAGCACTAAAGAC (SEQ ID NO: 584) | CAAAAGAGCGCCCCCGTCATGAACCACTGGCACAGCTAACTCCTGAAAAT (SEQ ID NO: 585) |
| DTX1 | NM_004416.2 | TCTTCATCTCTCTGGACTCTGATCTCCTTCTCCCTTCCCATCTCCAGGCCTTCTGTCTGTCCCAGATAAAGGCGCTGTTCTCCCATCCTCCCTACCCCAT (SEQ ID NO: 586) | GGCCTGGAGATGGGAAGGGAGAAGGAGATCAGAGTCCAGAGAGATGAAGA (SEQ ID NO: 587) | GGTAGGGAGGATGGGAGAACAGCGCCTTTATCTGGGACAGACAGAA (SEQ ID NO: 588) |
| E2F2 | NM_004091.2 | TCAGGGACCCTGTGTAGGATCTCGTTTGTGGTGAGTGGGCCGCTCTGAGGTCTCCACTGGGCTGCCATTTAGCCATGTGCCATCTCTGAAGTCAGAGGTG (SEQ ID NO: 589) | CCTCAGAGCAGCCCACTCACCACAAACGAGATCCTACACAG (SEQ ID NO: 590) | TGACTTCAGAGATGGCACATGGCTAAATGGCAGCAGAGTGGAGA (SEQ ID NO: 591) |
| E2F8 | NM_024680.2 | CTCGTGCGCTTAGTCCGGAGCCCTGATCTGCGAACAGGATATTAAAACTTTTAGTACAATTGATTGGACTACTTGAACCATCGGGATTTGGGAGGAACT (SEQ ID NO: 592) | AAGTTTTAATATCCTGTTCGCAGATCAGGGCTCCGGACTAAGCGCACGAG (SEQ ID NO: 593) | AGTTCCTCCCCAAATCCCGATGGTTCAAGTAGTCCAATCAATTGTACTAA (SEQ ID NO: 594) |
| EEPD1 | NM_030636.2 | TGCTTTTTGCAACCAAAGCTGTGGACAGAAAAGCCTCCTTAAGTGAGCTGAGGGGACAGGAAATCCAATCAGATGACCTTTGTGTTCGTAATCGGGCTTG (SEQ ID NO: 595) | CAGCTCACTTAAGGAGGCTTTTCTGTCCACAGCTTTGGTTGCAAAAGCA (SEQ ID NO: 596) | CAAGCCCGATTACGAACACAAAGGTCATCTGATTGGATTTCCTGTCCCCT (SEQ ID NO: 597) |
| EFEMP2 | NM_016938.3 | GTCTACCCCGGTGCCTACAATGCCTTTCAGATCCGTGCTGGAAACTGCAGGGGGACTTTTACATTAGGCAAATCAACAACGTCAGCGCCATGCTGGTCC (SEQ ID NO: 598) | TGCGAGTTTCCAGCACGGATCTGAAAGGCATTGTAGGCACCGGGGTAGAC (SEQ ID NO: 599) | GGACCAGCATGGCGCTGACGTTGTTGATTTGCCTAATGTAAAAGTCCCCC (SEQ ID NO: 600) |
| EGFL7 | NM_016215.3 | GCAGGGCCTTCCTCCTCTTCCTCCTCCCCTTCCTCGGGAGGCTCCCCAGACCCTGGCATGGGATGGGCTGGGATCTTCTCTGTGAATCCACCCCTGGCTA (SEQ ID NO: 601) | TCTGGGGAGCCTCCCGAGGAAGGGGAGGAGGAAGAGGA (SEQ ID NO: 602) | GATTCACAGAGAAGATCCCAGCGATCCCATGCCAGGG (SEQ ID NO: 603) |
| EHD2 | NM_014601.2 | GACGACGAGGCCGAGTGGGTGGTGACC | TCGTCGTATTTGGACTTGTCCTTGGT | GCTTGCCGTCGGCAGGCGCCAGGT |

TABLE 1-continued

| Gene | GenBank Accession No. | Target Sequence | Capture Probe Sequence | Reporter Probe Sequence |
|---|---|---|---|---|
| | | AAGGACAAGTCCA AATACGACGAGAT CTTCTACAACCTGG CGCCTGCCGACGGC AAGCTGAGCGGCTC CAAGG (SEQ ID NO: 604) | CACCACCCACTC GGC (SEQ ID NO: 605) | TGTAGAAGATC (SEQ ID NO: 606) |
| EIF5AL1 | NM_001099692.1 | AGGGCCAGAAGCT GTTCTTTCCCTTAA AAGGGCAAACTCA TTTCCACACTATGG GGACTCTGACAGAT AGCATACCTTCCTG TCTATGGCTATTGG ACCT (SEQ ID NO: 607) | AGTGTGGAAATG AGTTTGCCCTTTT AAGGGAAAGAAC AGCTTCTGGCCCT (SEQ ID NO: 608) | CAATAGCCATAG ACAGGAAGGTAT GCTATCTGTCAG AGTCCCCAT (SEQ ID NO: 609) |
| ELL2 | NM_012081.5 | AATCCCGCAACCGA AGCACAAAAGTTAT CAAACCCGGTGGA CCATATGTAGGGAA AAGAGTGCAAATTC GGAAAGCACCTCA AGCTGTTTCAGATA CAGT (SEQ ID NO: 610) | TACATATGGTCCA CCGGGTTTGATA ACTTTTGTGCTTC GGTTGCGGGATT (SEQ ID NO: 611) | ACTGTATCTGAA ACAGCTTGAGGT GCTTTCCGAATT TGCACTCTTTTC CC (SEQ ID NO: 612) |
| EML1 | NM_004434.2 | CCGGAGACTACGA AATCCTCTACTGGG TTCCCTCTGCCTGT AAGCAAGTCGTAA GTGTGGAAACTACA AGAGACATTGAAT GGGCTACCTATACC TGCAC (SEQ ID NO: 613) | GACTTGCTTACAG GCAGAGGGAACC CAGTAGAGGATT TCGTAGTCTCCGG (SEQ ID NO: 614) | GTGCAGGTATAG GTAGCCCATTCA ATGTCTCTTGTA GTTTCCACACTT AC (SEQ ID NO: 615) |
| EMR1 | NM_001974.3 | TTCAAAGACCACCA GGCTCCCTTGACCA CCTCTGAGATCAAG CTGAAGATGAATTC TCGAGTCGTTGGGG GCATAATGACTGGA GAGAAGAAAGACG GCT (SEQ ID NO: 616) | ATCTTCAGCTTGA TCTCAGAGGTGG TCAAGGGAGCCT G (SEQ ID NO: 617) | AGCCGTCTTTCT TCTCTCCAGTCA TTATGCCCCCAA CGACTCGAGAAT TC (SEQ ID NO: 618) |
| ENO1 | NM_001428.2 | TTCTCGCCTCACTT TCCACCAAGTGTCT AGAGTCATGTGAGC CTCGTGTCATCTCC GGGGTGGCCACAG GCTAGATCCCCGGT GGTTTTGTGCTCAA AAT (SEQ ID NO: 619) | GACACGAGGCTC ACATGACTCTAG ACACTTGGTGGA AAGTGAGGCGAG AA (SEQ ID NO: 620) | ATTTTGAGCACA AAACCACCGGG GATCTAGCCTGT GGCCACCCCGGA GAT (SEQ ID NO: 621) |
| ENPP3 | NM_005021.2 | CTTTTTATGAGCCA TCCCATGCAGAGGA GGTGTCAAAGTTTT CTGTTTGTGGCTTT GCTAATCCATTGCC CACAGAGTCTCTTG ACTGTTTCTGCCCT CA (SEQ ID NO: 622) | ACAAACAGAAAA CTTTGACACCTCC TCTGCATGGGAT GGCTCATAAAAA G (SEQ ID NO: 623) | TGAGGGCAGAA ACAGTCAAGAG ACTCTGTGGGCA ATGGATTAGCAA AGCC (SEQ ID NO: 624) |
| ENTPD1 | NM_001776.4 | TTCAGTAACTTTA GGAAAATGAGCTG CTGGACTCCTCAGT CAATCTGTCCTTTC TAGTCAATGAAAA AGACAGGGTTTGA GGTTCCTTCCGAAA CGGGG (SEQ ID NO: 625) | GACAGATTGACT GAGGAGTCCAGC AGCTCATTTTCCT AAAGTTACTCGA A (SEQ ID NO: 626) | CCCCGTTTCGGA AGGAACCTCAAA CCCTGTCTTTTTC ATTGACTAGAAA G (SEQ ID NO: 627) |

TABLE 1-continued

| Gene | GenBank Accession No. | Target Sequence | Capture Probe Sequence | Reporter Probe Sequence |
|---|---|---|---|---|
| EP300 | NM_001429.2 | CCAGCCAGGCCCA ACAGAGCAGTCCTG GATTAGGTTTGATA AATAGCATGGTCAA AAGCCCAATGACA CAGGCAGGCTTGAC TTCTCCCAACATGG GGAT (SEQ ID NO: 628) | CATGCTATTTATC AAACCTAATCCA GGACTGCTCTGTT GGGCCTGGCTGG (SEQ ID NO: 629) | CCCATGTTGGGA GAAGTCAAGCCT GCCTGTGTCATT GGGCTTTTGAC (SEQ ID NO: 630) |
| EPHB1 | NM_004441.3 | GCAGCGGCCGGGG TCGTGTTCGTTGTG TCCTTGGTGGCCAT CTCTATCGTCTGTA GCAGGAAACGGGC TTATAGCAAAGAG GCTGTGTACAGCGA TAAGC (SEQ ID NO: 631) | ACGATAGAGATG GCCACCAAGGAC ACAACGAACACG ACCCCGGCCGCT G (SEQ ID NO: 632) | GCTTATCGCTGT ACACAGCCTCTT TGCTATAAGCCC GTTTCCTGCTAC AG (SEQ ID NO: 633) |
| EPSTI1 | NM_001002264.1 | AGAGAAGCATTTA GAGAGCATCAGCA ATACAAAACCGCTG AGTTCTTGAGCAAA CTGAACACAGAATC GCCAGACAGAAGT GCCTGTCAAAGTGC TGTTT (SEQ ID NO: 634) | CTCAAGAACTCA GCGGTTTTGTATT GCTGATGCTCTCT AAATGCTTCTCT (SEQ ID NO: 635) | AAACAGCACTTT GACAGGCACTTC TGTCTGGCGATT CTGTGTTCAGTT TG (SEQ ID NO: 636) |
| ERBB2IP | NM_018695.2 | CACAGAGACCCCTT TCTGCACGAACATA CAGCATAGATGGTC CAAATGCATCAAG ACCTCAGAGTGCTC GACCCTCTATTAAT GAAATACCAGAGA GAAC (SEQ ID NO: 637) | TGCATTTGGACCA TCTATGCTGTATG TTCGTGCAGAAA GGGGTCTCTGTG (SEQ ID NO: 638) | GTTCTCTCTGGT ATTTCATTAATA GAGGGTCGAGC ACTCTGAGGTCT TGA (SEQ ID NO: 639) |
| ERG | NM_182918.3 | GACCTCATCATTAT GTGGGGCTTTGTT CTCCACAGGGTCAG GTAAGAGATGGCCT TCTTGGCTGCCACA ATCAGAAATCACGC AGGCATTTTGGGTA GG (SEQ ID NO: 640) | TCTCTTACCTGAC CCTGTGGAGAAC AAAGCCCCCACA TAATGATGAGGT C (SEQ ID NO: 641) | CCTACCCAAAAT GCCTGCGTGATT TCTGATTGTGGC AGCCAAGAAGG CCA (SEQ ID NO: 642) |
| ERN2 | NM_033266.2 | ATCGAAGGACCAA TGTACGTCACAGAA ATGGCCTTTCTCTC TGACCCAGCAGATG GCAGCCTGTACATC TTGGGGACCCAAA AACAACAGGGATT AATGA (SEQ ID NO: 643) | GCTGGGTCAGAG AGAAAGGCCATT TCTGTGACGTACA TTGGTCCTTCGAT (SEQ ID NO: 644) | TCATTAATCCCT GTTGTTTTTGGG TCCCCAAGATGT ACAGGCTGCCAT CT (SEQ ID NO: 645) |
| ERP29 | NM_001034025.1 | TAACCTGCTGGCTG TGAGTCCCTTGTGG AATATAAGGGGGT AGTGGGAAAAGTG GTACTAACCCACGA TTCTGAGCCCTGAG TATGCCTGGACATT GATG (SEQ ID NO: 646) | TTTCCCACTACCC CCTTATATTCCAC AAGGGACTCACA GC (SEQ ID NO: 647) | CAGGCATACTCA GGGCTCAGAATC GTGGGTTAGTAC CACT (SEQ ID NO: 648) |
| ERP44 | NM_015051.1 | TGAGGAAGTATTAC TTAGCATTCATGCA | GGGCTAGAGCCT AAGCCCAATATG | CTTGTCCTCAGT GACTTCACAGTC |

TABLE 1-continued

| Gene | GenBank Accession No. | Target Sequence | Capture Probe Sequence | Reporter Probe Sequence |
|---|---|---|---|---|
| | | TATTGGGCTTAGGC TCTAGCCCTGCCAC TATCATTGTCTTCT CTGGACTGTGAAGT CACTGAGGACAAG GAA (SEQ ID NO: 649) | CATGAATGCTAA GTAATACTTCCTC A (SEQ ID NO: 650) | CAGAGAAGACA ATGATAGTGGCA (SEQ ID NO: 651) |
| ESPL1 | NM_012291.4 | CAGGGACTTCACCT CTACACTGTGGTGG TTTATGACTTTGCC CAAGGCTGTCAGAT AGTTGATTTGGCTG ACCTGACCCAACTA GTGGACAGTTGTAA AT (SEQ ID NO: 652) | CAGCCTTGGGCA AAGTCATAAACC ACCACAGTGTAG AGGTGAAGTCC (SEQ ID NO: 653) | ATTTACAACTGT CCACTAGTTGGG TCAGGTCAGCCA AATCAACTATCT GA (SEQ ID NO: 654) |
| ETV6 | NM_001987.4 | GTATGAATATGAAA TCAGAGACCAGGG CATGATGTTGCTAG GATTAGAGCCTCTC AGTCTGGCCTCTTC ACCCAAGTGCAAG AACTCAGTCTCTTA CTGT (SEQ ID NO: 655) | GCTCTAATCCTAG CAACATCATGCC CTGGTCTCTGATT TCATATTCATAC (SEQ ID NO: 656) | ACAGTAAGAGA CTGAGTTCTTGC ACTTGGGTGAAG AGGCCAGACTGA GAG (SEQ ID NO: 657) |
| EXO1 | NM_003686.3 | GCCAGAGCCAGTG GGCTGAGCAAGAA GCCGGCAAGCATCC AGAAGAGAAAGCA TCATAATGCCGAGA ACAAGCCGGGGTT ACAGATCAAACTCA ATGAGC (SEQ ID NO: 658) | TTTCTCTTCTGGA TGCTTGCCGGCTT CTTGCTCAGCCCA CTG (SEQ ID NO: 659) | GCTCATTGAGTT TGATCTGTAACC CCGGCTTGTTCT CGGCATTATGAT GC (SEQ ID NO: 660) |
| FABP4 | NM_001442.2 | GGTGGAATGCGTCA TGAAAGGCGTCACT TCCACGAGAGTTTA TGAGAGAGCATAA GCCAAGGGACGTT GACCTGGACTGAA GTTCGCATTGAACT CTACA (SEQ ID NO: 661) | CTCTCTCATAAAC TCTCGTGGAAGT GACGCCTTTCATG ACGCATTCCACC (SEQ ID NO: 662) | TAGAGTTCAATG CGAACTTCAGTC CAGGTCAACGTC CCTTGGCTTATG (SEQ ID NO: 663) |
| FAM108C1 | NM_021214.1 | TCTGACATTCATGC AGGACTTGCCCTGT TGCCACCAATGTTC TCGGTATTTCACAT GCAGCTCTCTTTCT GCCACTGGATACAT GGGTTCAATCCATT TG (SEQ ID NO: 664) | AATACCGAGAAC ATTGGTGGCAAC AGGGCAAGTCCT GCATGAATGTCA GA (SEQ ID NO: 665) | CAAATGGATTGA ACCCATGTATCC AGTGGCAGAAA GAGAGCTGCATG TGA (SEQ ID NO: 666) |
| FAM159A | NM_001042693.1 | ACAGCTACATGTGG TGGCTCAGCATTGG CGCTCTCATAGGCC TGTCCGTAGCAGCA GTGGTTCTTCTCGC CTTCATTGTTACCG CCTGTGTGCTCTGC TA (SEQ ID NO: 667) | TACGGACAGGCC TATGAGAGCGCC AATGCTGAGCCA CCAC (SEQ ID NO: 668) | TAGCAGAGCACA CAGGCGGTAACA ATGAAGGCGAG AAGAACCACTGC TGC (SEQ ID NO: 669) |
| FAM171B | NM_177454.3 | CTTTTCTCCACACC GGAACAATTACATA CTGCTAAGTCAGCT ACTTTGCCAAGAAA GGGACAGTTAGTCT ATGGCCAATTGATG GAACCAGTAAATC GAG (SEQ ID NO: 670) | GGCAAAGTAGCT GACTTAGCAGTA TGTAATTGTTCCG GTGTGGAGAAAA G (SEQ ID NO: 671) | CTCGATTTACTG GTTCCATCAATT GGCCATAGACTA ACTGTCCCTTTC TT (SEQ ID NO: 672) |
| FAM189A1 | NM_015307.1 | CAGTGAACTCTCTG GTTTTATCTGGCGT | ACTGCTCAGTTCA AGGTGCTGCACG | TCTTTAGGTGAC GTAAGTGTCGCC |

TABLE 1-continued

| Gene | GenBank Accession No. | Target Sequence | Capture Probe Sequence | Reporter Probe Sequence |
|---|---|---|---|---|
| | | GCAGCACCTTGAAC TGAGCAGTGTTGCA CAAATGTGAATACA GCAACAGGCGACA CTTACGTCACCTAA AGA (SEQ ID NO: 673) | CCAGATAAAACC AGAGAGTTCACT G (SEQ ID NO: 674) | TGTTGCTGTATT CACATTTGTGCA AC (SEQ ID NO: 675) |
| FAM46C | NM_017709.3 | TTGGAATGGGTCTA CAGTGTATCATGAG CCAACCCTCAAAGG ACCCGTATTACAGT GCCACGTTGGAAA ACGCTACAGGAAG CATGACCTATCCAC ATCT (SEQ ID NO: 676) | ATACGGGTCCTTT GAGGGTTGGCTC ATGATACACTGT AGACCCATTCCA A (SEQ ID NO: 677) | AGATGTGGATAG GTCATGCTTCCT GTAGCGTTTTCC AACGTGGCACTG TA (SEQ ID NO: 678) |
| FAM69A | NM_001006605.3 | GTGCCAGAGACAA ACCTGAAAGAACTT ATTAAGGATCGTCA CTGTGAGTCTGATT TGGACTGTGTCTAT GGCACAGATTGTAG AACTAGCTGTGATC AGA (SEQ ID NO: 679) | GACTCACAGTGA CGATCCTTAATAA GTTCTTTCAGGTT TGTCTCTGGCAC (SEQ ID NO: 680) | TCTGATCACAGC TAGTTCTACAAT CTGTGCCATAGA CACAGTCCAAAT CA (SEQ ID NO: 681) |
| FAM83D | NM_030919.2 | CAC GTTGATTGATG GCATCCGCGTGGCA ACAGGCTCCTACAG TTTTACATGGACGG ATGGCAAATTAAAC AGCAGTAACTTGGT AATTCTGTCTGGCC AA (SEQ ID NO: 682) | ATGTAAAACTGT AGGAGCCTGTTG CCACGCGGATGC CATCAATCAACG TG (SEQ ID NO: 683) | TTGGCCAGACAG AATTACCAAGTT ACTGCTGTTTAA TTTGCCATCCGT CC (SEQ ID NO: 684) |
| FAP | NM_004460.2 | GCATTGGAAGCTAT CCTCCAAGCAAGA AGTGTGTTACTTGC CATCTAAGGAAAG AAAGGTGCCAATAT TACACAGCAAGTTT CAGCGACTACGCCA AGTA (SEQ ID NO: 685) | CCTTAGATGGCA AGTAACACACTT CTTGCTTGGAGG ATAGCTTCCAATG C (SEQ ID NO: 686) | TACTTGGCGTAG TCGCTGAAACTT GCTGTGTAATAT TGGCACCTTTCT TT (SEQ ID NO: 687) |
| FAR2 | NM_018099.3 | TCTTTCAGGAGCTA TAAAAGAAAGGGA GGAATCATGTCCAC AATTGCAGCTTTCT ATGGCGGCAAGTCC ATTCTCATCACGGG GGCCACAGGCTTTC TGG (SEQ ID NO: 688) | GCTGCAATTGTG GACATGATTCCTC CCTTTCTTTTATA GCTCCTGAAAGA (SEQ ID NO: 689) | CAGAAAGCCTGT GGCCCCCGTGAT GAGAATGGACTT GCCGCCATAGAA A (SEQ ID NO: 690) |
| FARP1 | NM_005766.2 | TCATGGTACGTAGT CCCCGGCACCTGTC GTTATTCCTATATC CTCCTGCAACTGTG GTTTGAAACTGCGC ATTCTCTAGTAGTA TATATCGTGCCTGT CT (SEQ ID NO: 691) | TGCAGGAGGATA TAGGAATAACGA CAGGTGCCGGGG ACTACGTACCAT GA (SEQ ID NO: 692) | AGACAGGCACG ATATATACTACT AGAGAATGCGC AGTTTCAAACCA CAGT (SEQ ID NO: 693) |
| FAS | NM_000043.3 | CACCGGGGCTTTTC GTGAGCTCGTCTCT GATCTCGCGCAAGA GTGACACACAGGT GTTCAAAGACGCTT CTGGGGAGTGAGG GAAGCGGTTTACGA GTGA (SEQ ID NO: 694) | TGTGTCACTCTTG CGCGAGATCAGA GACGAGCTCACG AAAAGCCCCGG (SEQ ID NO: 695) | TCACTCGTAAAC CGCTTCCCTCAC TCCCCAGAAGCG TCTTTGAACACC TG (SEQ ID NO: 696) |

TABLE 1-continued

| Gene | GenBank Accession No. | Target Sequence | Capture Probe Sequence | Reporter Probe Sequence |
|---|---|---|---|---|
| FBP2 | NM_003837.2 | AGATGAGGTGAAG AAACTGGATGTGCT ATCCAATTCCCTGG TGATCAACATGGTC CAATCCTCCTATAG TACCTGCGTCCTGG TCTCAGAAGAGAAT AAG (SEQ ID NO: 697) | TGTTGATCACCAG GGAATTGGATAG CACATCCAGTTTC TTCACCT (SEQ ID NO: 698) | TTATTCTCTTCTG AGACCAGGACG CAGGTACTATAG GAGGATTGGACC A (SEQ ID NO: 699) |
| FBXL13 | NM_145032.3 | ACGATGCGACTCCT GCCGAGGCACTTCC ACAACTTACAGAAT CTTAGTTTGGCTTA TTGCAGACGGTTCA CAGACAAAGGCTT ACAGTACCTGAACT TGG (SEQ ID NO: 700) | AAACTAAGATTC TGTAAGTTGTGG AAGTGCCTCGGC AGGAGTCGCATC GT (SEQ ID NO: 701) | CCAAGTTCAGGT ACTGTAAGCCTT TGTCTGTGAACC GTCTGCAATAAG CC (SEQ ID NO: 702) |
| FBXO10 | NM_012166.2 | TCAGCTCCACAGCC CATAGCAAGAAGA AAGTGGGCAATGTT TTTCAGGGAGAAG GGATAGAAGCTGG TGGGTTTCCAGTCA CTCGAAGTCTATAA AGATT (SEQ ID NO: 703) | TCCCTGAAAAAC ATTGCCCACTTTC TTCTTGCTATGGG CTGTGGAG (SEQ ID NO: 704) | AATCTTTATAGA CTTCGAGTGACT GGAAACCCACCA GCTTCTATCCCT TC (SEQ ID NO: 705) |
| FBXO11 | NM_018693.2 | TGCAGATATGGTTG CAGAAGAATCAGG TCCTGGTGCACAAA ATAGTCCATACCAA CTTCGTAGAAAAAC TCTTTTGCCGAAAA GAACAGCGTGTCCC ACA (SEQ ID NO: 706) | ATGGACTATTTTG TGCACCAGGACC TGATTCTTCTGCA ACCATATCTGCA (SEQ ID NO: 707) | TGTGGGACACGC TGTTCTTTTCGG CAAAAGAGTTTT TCTACGAAGTTG GT (SEQ ID NO: 708) |
| FBXO36 | NM_174899.4 | AGCAAAGACTATTA CCAGTTACTGGTCA CCCGGTCTCAGGTA ATCTTTAGATGGTG GAAGATCTCTCTAA GGAGTGAGTATCG ATCAACAAAACCTG GAG (SEQ ID NO: 709) | CTAAAGATTACCT GAGACCGGGTGA CCAGTAACTGGT AATAGTCTTTGCT (SEQ ID NO: 710) | CAGGTTTTGTTG ATCGATACTCAC TCCTTAGAGAGA TCTTCCACCAT (SEQ ID NO: 711) |
| FBXO41 | NM_001080410.1 | TTTGTTCTCTCCTCG GGGATGAGCTCTGC TGCTGAGTAGGGA GCTTTTGCTTGCTG GGAGGCTCTATGCA TGGATTTTTTTG GT GACCATACAGCTAG GG (SEQ ID NO: 712) | GCAAAAGCTCCC TACTCAGCAGCA GAGCTCATCCCC GAGGAGAGAACA AA (SEQ ID NO: 713) | CCCTAGCTGTAT GGTCACCAAAAA AATCCATGCATA GAGCCTCCCAGC AA (SEQ ID NO: 714) |
| FCER2 | NM_002002.4 | AACTTGGAAAGCC ACCACGGTGACCA GATGGCGCAGAAA TCCCAGTCCACGCA GATTTCACAGGAAC TGGAGGAACTTCGA GCTGAACAGCAGA GATTGA (SEQ ID NO: 715) | GTGGACTGGGAT TTCTGCGCCATCT GGTCACCGTG (SEQ ID NO: 716) | AATCTCTGCTGT TCAGCTCGAAGT TCCTCCAGTTCC TGTGAAATCTGC (SEQ ID NO: 717) |
| FCN2 | NM_015837.2 | ACCAGGACAATGA TCTTAACACCGGAA | TCCCTGAAACATC ACAGCACAATTT | TAGCGACCATTC AGGTTTGACACA |

TABLE 1-continued

| Gene | GenBank Accession No. | Target Sequence | Capture Probe Sequence | Reporter Probe Sequence |
|---|---|---|---|---|
| | | ATTGTGCTGTGATG TTTCAGGGAGCTTG GTGGTACAAAAACT GCCATGTGTCAAAC CTGAATGGTCGCTA CCT (SEQ ID NO: 718) | CCGGTGTTAAGA TCATTGTCCTGGT (SEQ ID NO: 719) | TGGCAGTTTTTG TACCACCAAGC (SEQ ID NO: 720) |
| FEZ1 | NM_005103.3 | TAAACGTGTATAGC TTAACCTGGATTAA ACACGAGCAAGCG CGCGGGGTCCTTTG CCGTTGGCTTCTAG TGCTAGTAATCATT GGATGCATGATGG GGCA (SEQ ID NO: 721) | GACCCCGCGCGC TTGCTCGTGTTTA ATCCAGGTTAAG CTATACACGTTTA (SEQ ID NO: 722) | TGCCCCATCATG CATCCAATGATT ACTAGCACTAGA AGCCAACGGCA AAG (SEQ ID NO: 723) |
| FGL2 | NM_006682.2 | CAATTCAGCAGGAT CGAGGAGGTGTTCA AAGAAGTCCAAAA CCTCAAGGAAATCG TAAATAGTCTAAAG AAATCTTGCCAAGA CTGCAAGCTGCAGG CTG (SEQ ID NO: 724) | TCCTTGAGGTTTT GGACTTCTTTGAA CACCTCCTCGATC CTGCTGAATTG (SEQ ID NO: 725) | CAGCCTGCAGCT TGCAGTCTTGGC AAGATTTCTTTA GACTATTTACGA TT (SEQ ID NO: 726) |
| FKBP11 | NM_016594.2 | AAAGCAGGTGATTC CAGGTCTGGAGCA GAGTCTTCTCGACA TGTGTGTGGGAGAG AAGCGAAGGGCAA TCATTCCTTCTCAC TTGGCCTATGGAAA ACGG (SEQ ID NO: 727) | CCACACACATGT CGAGAAGACTCT GCTCCAGACCTG GAATCACCTG (SEQ ID NO: 728) | TTCCATAGGCCA AGTGAGAAGGA ATGATTGCCCTT CGCTTCTCTC (SEQ ID NO: 729) |
| FKBP2 | NM_057092.2 | CCACGGCCACGGG GGCCGAGGGCAAA AGGAAGCTGCAGA TCGGGGTCAAGAA GCGGGTGGACCACT GTCCCATCAAATCG CGCAAAGGGGATG TCCTGCA (SEQ ID NO: 730) | CTTGACCCCGATC TGCAGCTTCCTTT TGCCCTCGG (SEQ ID NO: 731) | CCCTTTGCGCGA TTTGATGGGACA GTGGTCCACCCG CTT (SEQ ID NO: 732) |
| FLJ42418 | NM_001001695.1 | TCCCATTCTTACTG GCTGAAATTCAAAG CTGATAAATGGAGC TAGAGCAGATAGCT GGGAAAATGAGTT GAGGGTCTTACATT AAGACTTGCCAGCA AGA (SEQ ID NO: 733) | CTGCTCTAGCTCC ATTTATCAGCTTT GAATTTCAGCCA GTAAGAATGGGA (SEQ ID NO: 734) | TCTTGCTGGCAA GTCTTAATGTAA GACCCTCAACTC ATTTTCCCAGCT AT (SEQ ID NO: 735) |
| FLNA | NM_001456.3 | CCCTCAGGAGCCCT GGAGGAGTGCTAT GTCACAGAAATTGA CCAAGATAAGTATG CTGTGCGCTTCATC CCTCGGGAGAATG GCGTTTACCTGATT GACG (SEQ ID NO: 736) | TTATCTTGGTCAA TTTCTGTGACATA GCACTCCTCCAG GGCTCCTGAG (SEQ ID NO: 737) | CGTCAATCAG GT AAACGCCATTCT CCCGAGGGATGA AGCGCACAGCAT AC (SEQ ID NO: 738) |
| FN1 | NM_212482.1 | GGGAATGGACATG CATTGCCTACTCGC AGCTTCGAGATCAG TGCATTGTTGATGA CATCACTTACAATG TGAACGACACATTC CACAAGCGTCATGA AGA (SEQ ID NO: 739) | AACAATGCACTG ATCTCGAAGCTG CGAGTAGGCAAT GCATGTCCATTCC C (SEQ ID NO: 740) | TCTTCATGAC GC TTGTGGAATGTG TCGTTCACATTG TAAGTGATGTCA TC (SEQ ID NO: 741) |

TABLE 1-continued

| Gene | GenBank Accession No. | Target Sequence | Capture Probe Sequence | Reporter Probe Sequence |
|---|---|---|---|---|
| FNBP1 | NM_015033.2 | CATGACCTCCAAAC CCAAAATCCACTGC TTCAGGAGCCTAAA GCGTGGGCTTTCTC TCAAGCTGGGTGCA ACACCGGAGGATTT CAGCAACCTCCCAC CT (SEQ ID NO: 742) | GCCCACGCTTTAG GCTCCTGAAGCA GTGGATTTTGGGT TTGGAGGTCATG (SEQ ID NO: 743) | GTGGGAGGTTGC TGAAATCCTCCG GTGTTGCACCCA GCTTGAGAGAAA (SEQ ID NO: 744) |
| FNDC1 | NM_032532.2 | GATTATAAGCAGAT CGCTAACAGGCGTG TGCTGATTGAGAAC CTGATTCCAGACAC TGTGTATGAATTTG CAGTCCGTATTTCA CAGGGTGAAAGAG ATG (SEQ ID NO: 745) | GGAATCAGGTTC TCAATCAGCACA CGCCTGTTAGCG ATCTGCTTATAAT C (SEQ ID NO: 746) | CATCTCTTTCAC CCTGTGAAATAC GGACTGCAAATT CATACACAGTGT CT (SEQ ID NO: 747) |
| FOXM1 | NM_021953.2 | AAGTCTTTTGTATT GGGTCAGGAGTTG AATTTGGGGTGGGA GGATGGATGCAACT GAAGCAGAGTGTG GGTGCCCAGATGTG CGCTATTAGATGTT TCTC (SEQ ID NO: 748) | CATCCATCCTCCC ACCCCAAATTCA ACTCCTGACCCA ATACAAAAGACT T (SEQ ID NO: 749) | GAGAAACATCTA ATAGCGCACATC TGGGCACCCACA CTCTGCTTCAGT TG (SEQ ID NO: 750) |
| FOXO1 | NM_002015.3 | TCTCATCACCAACA TCATTAACTGTTTC GACCCAGTCCTCAC CTGGCACCATGATG CAGCAGACGCCGT GCTACTCGTTTGCG CCACCAAACACCA GTTT (SEQ ID NO: 751) | GGTGCCAGGTGA GGACTGGGTCGA AACAGTTAATGA TGTTGGTGATGA GA (SEQ ID NO: 752) | AAACTGGTGTTT GGTGGCGCAAAC GAGTAGCACGGC GTCTGCTGCATC AT (SEQ ID NO: 753) |
| FOXP1 | NM_001012505.1 | TGCTAGCCAAAAG GCTTCCCTCTGTGT GTTGCAGTCCTGTG GCATTATGCATGCC CCCTCCCAGTGACC CCAGGCTTTTTATG GCTGTGAGACACGT TAA (SEQ ID NO: 754) | GCATAATGCCAC AGGACTGCAACA CACAGAGGGAAG CCTTTTGGCTAGC A (SEQ ID NO: 755) | GCCATAAAAAGC CTGGGGTCACTG GGAGGGGGCAT (SEQ ID NO: 756) |
| FSCN1 | NM_003088.2 | CCCTGCCCTCTTGT CTGCCACGGGGCG AGTCTGGCACCTCT TTCTTCTGACCTCA GACGGCTCTGAGCC TTATTTCTCTGGAA GCGGCTAAGGGAC GGTT (SEQ ID NO: 757) | TCAGAAGAAAGA GGTGCCAGACTC GCCCCGTGGCAG ACAAGAG (SEQ ID NO: 758) | CCTTAGCCGCTT CCAGAGAAATA AGGCTCAGAGCC GTCTGAGG (SEQ ID NO: 759) |
| FUT8 | NM_004480.3 | GACATCATGAAAG GATTCTGATGGCAA TTACTGTCTCATTA GTGAACAATAAAA GAAAAATTGTTGTA TTAGCACAACCTAC TACTGTGAAGAGG AAAAG (SEQ ID NO: 760) | ATTGTTCACTAAT GAGACAGTAATT GCCATCAGAATC CTTTCATGATGTC (SEQ ID NO: 761) | CTTTTCCTCTTCA CAGTAGTAGGTT GTGCTAATACAA CAATTTTTCTTTT (SEQ ID NO: 762) |
| FYB | NM_001465.3 | ATGTAAAGTCCCTC ATGGCGAAATATA | CTCTGTCGGGTTG CCCCCCGTGTTAT | GATGAGTTTGGC CCTGTGACTCTG |

TABLE 1-continued

| Gene | GenBank Accession No. | Target Sequence | Capture Probe Sequence | Reporter Probe Sequence |
|---|---|---|---|---|
| | | ACACGGGGGCAA CCCGACAGAGGAT GTCTCAGTCAATAG CCGACCCTTCAGAG TCACAGGGCCAAA CTCATC (SEQ ID NO: 763) | ATTTCGCCATGAG GGACTTTACAT (SEQ ID NO: 764) | AAGGGTCGGCTA TTGACTGAGACA TC (SEQ ID NO: 765) |
| GAD2 | NM_000818.2 | TGTATGCCATGATG ATCGCACGCTTTAA GATGTTCCCAGAAG TCAAGGAGAAAGG AATGGCTGCTCTTC CCAGGCTCATTGCC TTCACGTCTGAACA TAG (SEQ ID NO: 766) | CTCCTTGACTTCT GGGAACATCTTA AAGCGTGCGATC ATCATGGCATAC A (SEQ ID NO: 767) | TTCAGACGTGAA GGCAATGAGCCT GGGAAGAGCAG CCATTCCTTT (SEQ ID NO: 768) |
| GATA1 | NM_002049.2 | TGCGGAAGGATGG TATTCAGACTCGAA ACCGCAAGGCATCT GGAAAAGGGAAAA AGAAACGGGGCTC CAGTCTGGGAGGC ACAGGAGCAGCCG AAGGACC (SEQ ID NO: 769) | CCCTTTTCCAGAT GCCTTGCGGTTTC GAGTCTGAATAC CATCCTTCCGCA (SEQ ID NO: 770) | CTCCTGTGCCTC CCAGACTGGAGC CCCGTTTCTTTTT (SEQ ID NO: 771) |
| GATA2 | NM_032638.3 | GAAGAAGGAAGGG ATCCAGACTCGGAA CCGGAAGATGTCCA ACAAGTCCAAGAA GAGCAAGAAGGG GCGGAGTGCTTCGA GGAGCTGTCAAAGT GCATG (SEQ ID NO: 772) | TGGACTTGTTGGA CATCTTCCGGTTC CGAGTCTGGATC CCTTCCTTCTTC (SEQ ID NO: 773) | CATGCACTTTGA CAGCTCCTCCAG GCACTCCGCCCC TTTCTTGCTCTTC T (SEQ ID NO: 774) |
| GBP1 | NM_002053.1 | CCAGATGACCAGC AGTAGACAAATGG ATACTGAGCAGAGT CTTAGGTAAAAGTC TTGGGAAATATTTG GGCATTGGTCTGGC CAAGTCTACAATGT CCCA (SEQ ID NO: 775) | TTTACCTAAGACT CTGCTCAGTATCC ATTTGTCTACTGC TGGTCATCTGG (SEQ ID NO: 776) | TGGGACATTGTA GACTTGGCCAGA CCAATGCCCAAA TATTTCCCAAGA CT (SEQ ID NO: 777) |
| GBP4 | NM_052941.4 | TTCTACAAGATATG CCATGGGCCTTTTC ACAGGGGACACAG GCTTCTTAAAACAA CCCGGCTTCCTCAC CCTATGTCCTTTAT TTACAAAGCTGTGC TCC (SEQ ID NO: 778) | TTAAGAAGCCTG TGTCCCCTGTGAA AAGGCCCATGGC ATATCTTGTAGAA (SEQ ID NO: 779) | GGAGCACAGCTT TGTAAATAAAGG ACATAGGGTGAG GAAGCCGGGTTG TT (SEQ ID NO: 780) |
| GCET2 | NM_001008756.1 | GGAAAGGAGTCAC CTTAACAAAGCTGC AGAAATCAACCTTA TGATTTGCCATCTC TCTTGGGTATTTTA GATGCTGGGATCAC CATATCGCTGAAGG GTG (SEQ ID NO: 781) | GGCAAATCATAA GGTTGATTTCTGC AGCTTTGTTAAGG TGACTCCTTTCC (SEQ ID NO: 782) | CACCCTTCAGCG ATATGGTGATCC CAGCATCTAAAA TACCCAAGAGAG AT (SEQ ID NO: 783) |
| GGT1 | NM_001032365.2 | CTCAGCAAGGCAA GTGAGGTGCTGCCG TCATCCAGGCTGGA CAGTTCAGTGATTT GCCTGAGGCCCCAC AGCAGAGTTCAACT GGAGACAGAGAAA CCAG (SEQ ID NO: 784) | ACTGAACTGTCC AGCCTGGATGAC GGCAGCACCTCA CTTG (SEQ ID NO: 785) | TCTCCAGTTGAA CTCTGCTGTGGG GCCTCAGGCAAA TC (SEQ ID NO: 786) |

TABLE 1-continued

| Gene | GenBank Accession No. | Target Sequence | Capture Probe Sequence | Reporter Probe Sequence |
|------|----------------------|-----------------|------------------------|-------------------------|
| GHR | NM_000163.2 | TTCATATAGTACAGTCCCCACAGGGCCTCATACTCAATGCGACTGCCTTGCCCTTGCCTGACAAAGAGTTTCTCTCATCATGTGGCTATGTGAGCACAGA (SEQ ID NO: 787) | CAAGGCAGTCGCATTGAGTATGAGGCCCTGTGGGACTGTACTATGAA (SEQ ID NO: 788) | TCTGTGCTCACATAGCCACATGATGAGAGAAACTCTTTGTCAGGCAAGGG (SEQ ID NO: 789) |
| GIT2 | NM_057169.2 | CAGATTTTACAGGCTGAATTATTGGCAGTATATGGAGCAGACCCAGGCACACAGGATTCTAGTGGGAAAACTCCCGTTGATTATGCAAGGCAAGGAGGGC (SEQ ID NO: 790) | GTGCCTGGGTCTGCTCCATATACTGCCAATAATTCAGCCTGTAAAATCTG (SEQ ID NO: 791) | GCCCTCCTTGCCTTGCATAATCAACGGGGAGTTTTCCCACTAGAATCCTGT (SEQ ID NO: 792) |
| GLDC | NM_000170.2 | AAAGCTTGGTGAGAATGATGCCTGGAAGAATGGTGGGGGTAACAAGAGATGCCACTGGGAAAGAAGTGTATCGTCTTGCTCTTCAAACCAGGGAGCAACA (SEQ ID NO: 793) | ATCTCTTGTTACCCCCACCATTCTTCCAGGCATCATTCTCACCAAGCTTT (SEQ ID NO: 794) | TGTTGCTCCCTGGTTTGAAGAGCAAGACGATACACTTCTTTCCCAGTGGC (SEQ ID NO: 795) |
| GLRX | NM_002064.2 | ATCCCATCCCACCTTGAAAATCACTGCTCTGAACCAGTGTTCTCCACCTTGTCCTCCACAGATCTCATAGGAAATGTTCAACAATTCTGTGAAAGGTCAC (SEQ ID NO: 796) | AAGGTGGAGAACACTGGTTCAGAGCAGTGATTTTCAAGGTGGGATGGAT (SEQ ID NO: 797) | GTGACCTTTCACAGAATTGTTGAACATTTCCTATGAGATCTGTGGAGGAC (SEQ ID NO: 798) |
| GNA13 | NM_006572.4 | TTTTCTTACAATATCTTCCTGCTATAAGAGCATTATGGGCAGACAGCGGCATACAGAATGCCTATGACCGGCGTCGAGAATTTCAACTGGGTGAATCTGT (SEQ ID NO: 799) | GCCGCTGTCTGCCCATAATGCTCTTATAGCAGGAAGATATTGTAAGAAAA (SEQ ID NO: 800) | ACAGATTCACCCAGTTGAAATTCTCGACGCCGGTCATAGGCATTCTGTAT (SEQ ID NO: 801) |
| GNB4 | NM_021629.3 | TGCCATCAGCAAGGATATCTCCTCCACTTTAATGGACAGGCCTCATTTTTGGCAGCTATGCTGTTTGAGATGTAGACTGAATATCCAAGGTTCCTCCCTA (SEQ ID NO: 802) | AAAAATGAGGCCTGTCCATTAAAGTGGAGGAGATATCCTTGCTGATGGCA (SEQ ID NO: 803) | TAGGGAGGAACCTTGGATATTCAGTCTACATCTCAAACAGCATAGCTGCC (SEQ ID NO: 804) |
| GNG10 | NM_001017998.2 | AACTTTTAGAGATATTTCAGCCCTTTCCTGTGGCCTGGTCCTATAGCCAAAATCACAGATATTCATGAGTTTCTACTTGAGTGAGAAAACTGGGTGAAGG (SEQ ID NO: 805) | TTGGCTATAGGACCAGGCCACAGGAAAGGGCTGAAATATCTCTAAAAGTT (SEQ ID NO: 806) | CCTTCACCCAGTTTTCTCACTCAAGTAGAAACTCATGAATATCTGTGATT (SEQ ID NO: 807) |
| GNG4 | NM_004485.2 | AATGAAAGAGGGCATGTCTAATAACAGCACCACTAGCATCTCCCAAGCCAGGAAAGCTGTGGAGCAGCTAAAGATGGAAGCCTGTATGGACAGGGTCAAG (SEQ ID NO: 808) | TGGCTTGGGAGATGCTAGTGGTGCTGTTATTAGACATGCCCTCTTTCATT (SEQ ID NO: 809) | TGTCCATACAGGCTTCCATCTTTAGCTGCTCCACAGCTTTCC (SEQ ID NO: 810) |

TABLE 1-continued

| Gene | GenBank Accession No. | Target Sequence | Capture Probe Sequence | Reporter Probe Sequence |
|---|---|---|---|---|
| GNL3 | NM_014366.4 | CATTCAGAAGTGAAGTCTGCTTTGGGAAAGAGGGCCTTTGGAAACTTCTTGGAGGTTTTCAGGAAACTTGCAGCAAAGCCATTCGGGTTGGAGTAATTGG (SEQ ID NO: 811) | AAGAAGTTTCCAAAGGCCCTCTTTCCCAAAGCAGACTTCACTTCTGAATG (SEQ ID NO: 812) | CCAATTACTCCAACCCGAATGGCTTTGCTGCAAGTTTCCTGAAAACCTCC (SEQ ID NO: 813) |
| GORASP1 | NM_031899.2 | GGCCAGCTTCCCTTAACTCTGTAGCCTGGCAGTCTGACCCAAAGTTGCCCTCACCCAAAGGTTCTGGCTCTTCCCTCCCTCACTTTTACTTTCCCTTCCC (SEQ ID NO: 814) | GGGCAACTTTGGGTCAGACTGCCAGGCTACAGAGTTAAGG (SEQ ID NO: 815) | GGGAAGGGAAAGTAAAAGTGAGGGAGGGAAGAGCCAGAACCTTTGGGTGA (SEQ ID NO: 816) |
| GPR116 | NM_015234.3 | TATGTTGGGGTGGGCTTTTCCATCTTGAGCTTGGCAGCCTGTCTAGTTGTGGAAGCTGTGGTGTGGAAATCGGTGACCAAGAATCGGACTTCTTATATGC (SEQ ID NO: 817) | ACAACTAGACAGGCTGCCAAGCTCAAGATGGAAAAGCCCACCCCAACATA (SEQ ID NO: 818) | GCATATAAGAAGTCCGATTCTTGGTCACCGATTTCCACACCACAGCTTCC (SEQ ID NO: 819) |
| GPR176 | NM_007223.1 | AGTATTCTGCTCTGTGACCATCCTCAGCTTCCCTGCTATTGCTTTGGACAGGTACTACTCAGTCCTCTATCCACTGGAGAGGAAAATATCTGATGCCAAG (SEQ ID NO: 820) | TGTCCAAAGCAATAGCAGGGAAGCTGAGGATGGTCACAGAGCAGAATACT (SEQ ID NO: 821) | CTTGGCATCAGATATTTTCCTCTCCAGTGGATAGAGGACTGAGTAGTACC (SEQ ID NO: 822) |
| GPR183 | NM_004951.3 | ACTGGAGAATCGGAGATGCCTTGTGTAGGATAACTGCGCTAGTGTTTTACATCAACACATATGCAGGTGTGAACTTTATGACCTGCCTGAGTATTGACCG (SEQ ID NO: 823) | GTAAAACACTAGCGCAGTTATCCTACACAAGGCATCTCCGATTCTCCAGT (SEQ ID NO: 824) | CGGTCAATACTCAGGCAGGTCATAAAGTTCACACCTGCATATGTGTTGAT (SEQ ID NO: 825) |
| GRAMD1B | NM_020716.1 | TTCCGCTGGGAAACTCTGCTGACAGTCCGTTTGAAAGACATCTGTTCCATGACTAAAGAAAAAACAGCTCGCCTCATTCCCAATGCCATCCAAGTTTGCA (SEQ ID NO: 826) | ATGGAACAGATGTCTTTCAAACGAGCTGTCAGCAGAGTTTCCCAGCGGAA (SEQ ID NO: 827) | TGCAAACTTGGATGGCATTGGGAATGAGGCGAGCTGTTTTTTCTTTAGTC (SEQ ID NO: 828) |
| GRB10 | NM_005311.4 | CCTTTGCCACGTCCCCTTAGCTTAGTGATCAGGTGTGAGAGTGGCCATTTCCTTACCTTTGATCCCTGTAAAGCAGAAAGGACTCCTTTGACAGGCGACA (SEQ ID NO: 829) | AAATGGCCACTCTCACACCTGATCACTAAGCTAAGGGGACGTGGCAAAG (SEQ ID NO: 830) | TGTCGCCTGTCAAAGGAGTCCTTTCTGCTTTACAGGGATCAAAGGTAAGG (SEQ ID NO: 831) |
| GRSF1 | NM_001098477.1 | CTTTCTAAGCCTTGTGCTAAAGGCGTATAACGGTGGTGCCTATCTACTTAAGGGGGCATTCTAGTCTTAACTTAAAAGTTGTCTAAACTGTCCCTCCCTG (SEQ ID NO: 832) | TAAGTAGATAGGCACCACCGTTATACGCCTTTAGCACAAGGCTTAGAAAG (SEQ ID NO: 833) | CAGGGAGGGACAGTTTAGACAACTTTTAAGTTAAGACTAGAATGCCCCCT (SEQ ID NO: 834) |

TABLE 1-continued

| Gene | GenBank Accession No. | Target Sequence | Capture Probe Sequence | Reporter Probe Sequence |
|------|----------------------|-----------------|------------------------|-------------------------|
| GSK3B | NM_002093.2 | ACTGATTATACCTCTAGTATAGATGTATGGTCTGCTGGCTGTGTGTTGGCTGAGCTGTTACTAGGACAACCAATATTTCCAGGGGATAGTGGTGTGGATC (SEQ ID NO: 835) | GCCAACACACAGCCAGCAGACCATACATCTATACTAGAGGTATAATCAGT (SEQ ID NO: 836) | GATCCACACCACTATCCCCTGGAAATATTGGTTGTCCTAGTAACAGCTCA (SEQ ID NO: 837) |
| GTSE1 | NM_016426.5 | GATGAAGTCTTCTTCGGACCCTTTGGACATAAAGAAAGATGTATTGCTGCCAGCTTGGAATTAAATAATCCGGTTCCCGAACAGCCTCCGTTGCCCACAT (SEQ ID NO: 838) | GCAGCAATACATCTTTCTTTATGTCCAAAGGGTCCGAAGAAGACTTCATC (SEQ ID NO: 839) | ATGTGGGCAACGGAGGCTGTTCGGAACCGGATTATTTAATTCCAAGCTG (SEQ ID NO: 840) |
| GXYLT2 | NM_001080393.1 | GTCATGCTCAAATCAGCTGTGCTTTTAGCCACAGGAAGATCCAATTCCACATCTTCACTGAAGACTCTCTGAAGCCCGAGTTTGATAAGCAGTTACGCC (SEQ ID NO: 841) | TGGAATTGGATCTTCCTGTGGCTAAAAGCACAGCTGATTTGAGCATGAC (SEQ ID NO: 842) | GGCGTAACTGCTTATCAAACTCGGGCTTCAGAGAGTCTTCAGTGAAGATG (SEQ ID NO: 843) |
| GYG2 | NM_001184704.1 | CTCTTGGCTTGGTCTCTACCCTCACTACCTCAGTTCTCAATAACTTAGTGAATCACTGCCCTCCTCAAAGCCATTTCCACTCAGCTCTTTCCAGAGAATT (SEQ ID NO: 844) | CACTAAGTTATTGAGAACTGAGGTAGTGAGGGTAGAGACCAAGCCAAGAG (SEQ ID NO: 845) | AATTCTCTGGAAAGAGCTGAGTGGAAATGGCTTTGAGGAGGGCAGTGATT (SEQ ID NO: 846) |
| GYPC | NM_016815.2 | AGTACTTTATTTGAGGGACAACAGACTTCACTTCCCTGAATGCCTCCCCCATCTCCATCAGGAAAAATACACCCCATCGCCCAGCACCCCTGCTGATACC (SEQ ID NO: 847) | GGGGGAGGCATTCAGGGAAGTGAAGTCTGTTGTCCCTCAAATAAAGTACT (SEQ ID NO: 848) | CAGGGGTGCTGGGCGATGGGGTGTATTTTTCCTGATGGAGAT (SEQ ID NO: 849) |
| H1FOO | NM_153833.1 | GGCTCCTGGGAGCGTCACCAGCGACATCTCACCCTCCTCGACTTCCACAGCAGGATCATCCAGGTCTCCTGAATCTGAAAAGCCAGGCCCGAGCCACGGC (SEQ ID NO: 850) | CTGTGGAAGTCGAGGAGGGTGAGATGTCGCTGGTGACGCT (SEQ ID NO: 851) | GCCTGGCTTTTCAGATTCAGGAGACCTGGATGATCCTG (SEQ ID NO: 852) |
| H2AFV | NM_138635.3 | ATGGCTTGTGTTACAAGTAGAGAGCAGTGGAGAGTTGGGCTTTGTAATTCTTTCAAGGGTGATTGTAGTTCTGGAGTCCTATCTACCTGGGTTCAGATCT (SEQ ID NO: 853) | GAATTACAAAGCCCAACTCTCCACTGCTCTCTACTTGTAACACAAGCCAT (SEQ ID NO: 854) | AGATCTGAACCCAGGTAGATAGGACTCCAGAACTACAATCACCCTTGAAA (SEQ ID NO: 855) |
| H2AFX | NM_002105.2 | CCGCCCCATTTCCCTTCCAGCAAACTCAACTCGGCAATCCAAGCACCTAGATACCAGCACAAGTCGGTTAATCCCTGTCTGGACTGAGCCTCCGTTGGCT (SEQ ID NO: 856) | CTAGGTGCTTGGATTGCCGAGTTGAGTTTGCTGAAGGGAAATGGGCGG (SEQ ID NO: 857) | CAACGGAGGCTCAGTCCAGACAGGGATTAACCGACTTGTGCTGGTAT (SEQ ID NO: 858) |

TABLE 1-continued

| Gene | GenBank Accession No. | Target Sequence | Capture Probe Sequence | Reporter Probe Sequence |
|---|---|---|---|---|
| HARBI1 | NM_173811.3 | TGCAGCAGTCTTCC CTCAGTAGTCAGTT TGAAGCGGGTATGC ACAAAGATAGCTG GCTTCTGGGTGACA GTTCCTTCTTTCTTC GAACCTGGCTCATG AC (SEQ ID NO: 859) | ATCTTTGTGCATA CCCGCTTCAAACT GACTACTGAGGG AAGACTGCTGCA (SEQ ID NO: 860) | GTCATGAGCCAG GTTCGAAGAAAG AAGGAACTGTCA CCCAGAAGCCAG CT (SEQ ID NO: 861) |
| HCK | NM_002110.2 | CCAGGTCGGAGGC AATACATTCTCAAA AACTGAAACCAGC GCCAGCCCACACTG TCCTGTGTACGTGC CGGATCCCACATCC ACCATCAAGCCGG GGCCT (SEQ ID NO: 862) | GTGGGCTGGCGC TGGTTTCAGTTTT TGAGAATGTATT GCCTCCGACCTG G (SEQ ID NO: 863) | CTTGATGGTGGA TGTGGGATCCGG CACGTACACAGG ACAGT (SEQ ID NO: 864) |
| HDAC1 | NM_004964.2 | CAAGCCGGTCATGT CCAAAGTAATGGA GATGTTCCAGCCTA GTGCGGTGGTCTTA CAGTGTGGCTCAGA CTCCCTATCTGGGG ATCGGTTAGGTTGC TTC (SEQ ID NO: 865) | CCACCGCACTAG GCTGGAACATCT CCATTACTTTGGA CATGACCGGCTT G (SEQ ID NO: 866) | AACCTAACCGAT CCCCAGATAGGG AGTCTGAGCCAC ACTGTAAGA (SEQ ID NO: 867) |
| HDAC2 | NM_001527.1 | AAGCCTATTATCTC AAAGGTGATGGAG ATGTATCAACCTAG TGCTGTGGTATTAC AGTGTGGTGCAGAC TCATTATCTGGTGA TAGACTGGGTTGTT TCA (SEQ ID NO: 868) | ACCACAGCACTA GGTTGATACATCT CCATCACCTTTGA GATAATAGGCTT (SEQ ID NO: 869) | TGAAACAACCCA GTCTATCACCAG ATAATGAGTCTG CACCACACTGTA AT (SEQ ID NO: 870) |
| HDGF | NM_004494.2 | TCATCAAGAGAATT TGGGGCTTCCAAGT TGTTCGGGCCAAGG ACCTGAGACCTGAA GGGTTGACTTTACC CATTTGGGTGGGAG TGTTGAGCATCTGT CC (SEQ ID NO: 871) | TCTCAGGTCCTTG GCCCGAACAACT TGGAAGCCCCAA ATTCTCTTGATGA (SEQ ID NO: 872) | GGACAGATGCTC AACACTCCCACC CAAATGGGTAAA GTCAACCCTTCA GG (SEQ ID NO: 873) |
| HEG1 | NM_020733.1 | GAAGTAACATCTCA TCCTATGACGGGA ATATGCTCAGCCTT CTACTGAGTCGCCA GTTCTGCATACATC CAACCTTCCGTCCT ACACACCCACCATT AA (SEQ ID NO: 874) | CTCAGTAGAAGG CTGAGCATATTCC CCGTCATAGGAT GAGATGTTACTTC (SEQ ID NO: 875) | TTAATGGTGGGT GTGTAGGACGGA AGGTTGGATGTA TGCAGAACTGGC GA (SEQ ID NO: 876) |
| HHIP | NM_022475.1 | GATTTGTATACCGG GGCTGCCAGTCAGA AAGATTGTATGGAA GCTACGTGTTTGGA GATCGTAATGGGA ATTTCCTAACTCTC CAGCAAAGTCCTGT GAC (SEQ ID NO: 877) | CACGTAGCTTCCA TACAATCTTTCTG ACTGGCAGCCCC GGTATACAAATC (SEQ ID NO: 878) | GTCACAGGACTT TGCTGGAGAGTT AGGAAATTCCCA TTACGATCTCCA AA (SEQ ID NO: 879) |
| HJURP | NM_018410.3 | AACAATACGACAG GGCCATGGAGAGA ACCGTCAGAGGGA GATTGAAATCCGAT TTGATCAGCTTCAT CGGGAATATTGCCT GAGTCCCAGGAAC CAGCCT (SEQ ID NO: 880) | GGATTTCAATCTC CCTCTGACGGTTC TCTCCATGGCC (SEQ ID NO: 881) | AGGCTGGTTCCT GGGACTCAGGCA ATATTCCCGATG AAGCTGATCAAA TC (SEQ ID NO: 882) |

TABLE 1-continued

| Gene | GenBank Accession No. | Target Sequence | Capture Probe Sequence | Reporter Probe Sequence |
|---|---|---|---|---|
| HLA-A | NM_002116.5 | GGAAGAGCTCAGATAGAAAAGGAGGGAGTTACACTCAGGCTGCAAGCAGTGACAGTGCCCAGGGCTCTGATGTGTCCCTCACAGCTTGTAAAGTGTGAGA (SEQ ID NO: 883) | ACTGCTTGCAGCCTGAGTGTAACTCCCTCCTTTTCTATCTGAGCTCTTCC (SEQ ID NO: 884) | TCTCACACTTTACAAGCTGTGAGGACACATCAGAGCCCTGGGCACTGTC (SEQ ID NO: 885) |
| HLA-B | NM_005514.6 | TGAATGTGTCTGCGTCCCTGTTAGCATAATGTGAGGAGGTGGAGAGACAGCCCACCCTTGTGTCCACTGTGACCCCTGTTCCCATGCTGACCTGTGTTTC (SEQ ID NO: 886) | CTGTCTCTCCACCTCCTCACATTATGCTAACAGGGACGCAGACACATT (SEQ ID NO: 887) | GAAACACAGGTCAGCATGGGAACAGGGGTCACAGTGGACACAAGGGTGGG (SEQ ID NO: 888) |
| HLA-C | NM_002117.4 | AGCTGGGAGCCATCTTCCCAGCCCACCATCCCCATCATGGGCATCGTTGCTGGCCTGGCTGTCCTGGTTGTCCTAGCTGTCCTTGGAGCTGTGGTCACCG (SEQ ID NO: 889) | GCAACGATGCCCATGATGGGGATGGTGGGCTGGGAAGATGGCTC (SEQ ID NO: 890) | CACAGCTCCAAGGACAGCTAGGACAACCAGGACAGCCAGGCCA (SEQ ID NO: 891) |
| HLA-DMA | NM_006120.3 | TTATTTGACAAAGAGTTCTGCGAGTGGATGATCCAGCAAATAGGGCCAAAACTTGATGGGAAAATCCCGGTGTCCAGAGGGTTTCCTATCGCTGAAGTGT (SEQ ID NO: 892) | TTTGGCCCTATTTGCTGGATCATCCACTCGCAGAACTCTTTGTCAAATAA (SEQ ID NO: 893) | ACACTTCAGCGATAGGAAACCCTCTGGACACCGGATTTTCCCATCAAGT (SEQ ID NO: 894) |
| HLA-DPA1 | NM_033554.2 | GGAGAGATCTGAACTCCAGCTGCCCTACAAACTCCATCTCAGCTTTTCTTCTCACTTCATGTGAAAACTACTCCAGTGGCTGACTGAATTGCTGACCCTT (SEQ ID NO: 895) | AAGAAAAGCTGAGATGGAGTTTGTAGGGCAGCTGGAGTTCAGATCTCTC (SEQ ID NO: 896) | AAGGGTCAGCAATTCAGTCAGCCACTGGAGAGAATTCACATGAAGTGAG (SEQ ID NO: 897) |
| HLA-DPB1 | NM_002121.4 | TCCAAATTGGATACTGCTGCCAAGAAGTTGCTCTGAAGTCAGTTTCTATCATTCTGCTCTTTGATTCAAAGCACTGTTTCTCTACTGGGCCTCCAACCA (SEQ ID NO: 898) | GATAGAAACTGACTTCAGAGCAACTTCTTGGCAGCAGTATCCAATTTGGA (SEQ ID NO: 899) | TGGTTGGAGGCCCAGTGAGAGAAACAGTGCTTTGAATCAAAGAGCAGAAT (SEQ ID NO: 900) |
| HLA-DRA | NM_019111.3 | GGCCAACATAGCTGTGGACAAAGCCAACCTGGAAATCATGACAAAGCGCTCCAACTATACTCCGATCACCAATGTACCTCCAGAGGTAACTGTGCTCACG (SEQ ID NO: 901) | AGCGCTTTGTCATGATTTCCAGGTTGGCTTTGTCCACAGCTATGTTGGCC (SEQ ID NO: 902) | CGTGAGCACAGTTACCTCTGGAGGTACATTGGTGATCGGAGTATAGTTGG (SEQ ID NO: 903) |
| HLA-E | NM_005516.4 | TGTCTTAGGGGACTCTGGCTTCTCTTTTTGCAAGGGCCTCTGAATCTGTCTGTGTCCCTGTTAGCACAATGTGAGGAGGTAGAGAAACAGTCCACCTCTG (SEQ ID NO: 904) | GACAGATTCAGAGGCCCTTGCAAAAAGAGAAGCCAGAGTCCCCTAAGCA (SEQ ID NO: 905) | TGGACTGTTTCTCTACCTCCTCACATTGTGCTAACAGGGACACA (SEQ ID NO: 906) |

TABLE 1-continued

| Gene | GenBank Accession No. | Target Sequence | Capture Probe Sequence | Reporter Probe Sequence |
|---|---|---|---|---|
| HLA-F | NM_001098479.1 | CCATTGGGCGTCGC GTTTCTAGAGAAGC CAATCAGTGTCGCC GCAGTTCCCAGGTT CTAAAGTCCCACGC ACCCCGCGGGACTC ATATTTTTCCCAGA CG (SEQ ID NO: 907) | GGAACTGCGGCG ACACTGATTGGCT TCTCTAGAAACG CGACGCCCAATG G (SEQ ID NO: 908) | CGTCTGGGAAAA ATATGAGTCCCG CGGGGTGCGTGG GACTTTAGAACC TG (SEQ ID NO: 909) |
| HOMER2 | NM_004839.2 | TGGAAGACAAAGT GCGTTCCTTAAAGA CAGACATTGAGGA GAGCAAATACCGA CAGCGCCACCTGAA GGTGGAGTTGAAG AGCTTCCTGGAGGT GCTGGA (SEQ ID NO: 910) | GTATTTGCTCTCC TCAATGTCTGTCT TTAAGGAACGCA CTTTGTCTTCCA (SEQ ID NO: 911) | AG GAAG CTCTTC AACTCCACCTTC AGGTGGCGCTGT CG (SEQ ID NO: 912) |
| HOPX | NM_001145460.1 | AACAATAGGAAGC TATGTGTATCTTCT GTGTAAAGCAGTG GCTTCACTGGAAAA ATGGTGTGGCTAGC ATTTCCCTTTGAGT CATGATGACAGATG GTGT (SEQ ID NO: 913) | CCAGTGAAGCCA CTGCTTTACACAG AAGATACACATA GCTTCCTATTGTT (SEQ ID NO: 914) | ACACCATCTGTC ATCATGACTCAA AGGGAAATGCTA GCCACACCATTT TT (SEQ ID NO: 915) |
| HPCAL1 | NM_134421.1 | CTGTTTCTAAGGAA ATGCATGTGTGCCC TGAGCCGTGATGAT CCTCCCATCCGTGT TGTGAGCACAGGC ATTTGTGTCTGGTC TGTCCTCCCTGTTG ATT (SEQ ID NO: 916) | ATGGGAGGATCA TCACGGCTCAGG GCACACATGCAT TTCCTTAGAAACA G (SEQ ID NO: 917) | AATCAACAGGG AGGACAGACCA GACACAAATGCC TGTGCTCACAAC ACGG (SEQ ID NO: 918) |
| HSP90AA1 | NM_005348.3 | GGTGGCGCGTCAGT TGCTTCAGCGTCCC GGTGTGGCTGTGCC GTTGGTCCTGTGCG GTCACTTAGCCAAG ATGCCTGAGGAAA CCCAGACCCAAGA CCAA (SEQ ID NO: 919) | GGACCAACGGCA CAGCCACACCGG GACGCTGAAGCA ACTGACG (SEQ ID NO: 920) | TCTGGGTTTCCT CAGGGCATCTTGG CTAAGTGACCGC ACA (SEQ ID NO: 921) |
| HSP90B1 | NM_003299.1 | TCAGAGCTGACGAT GAAGTTGATGTGGA TGGTACAGTAGAA GAGGATCTGGGTA AAAGTAGAGAAGG ATCAAGGACGGAT GATGAAGTAGTAC AGAGAGA (SEQ ID NO: 922) | CAGATCCTCTTCT ACTGTACCATCCA CATCAACTTCATC GTCAGCT (SEQ ID NO: 923) | TCTCTCTGTACT ACTTCATCATCC GTCCTTGATCCT TCTCTACTTTTAC C (SEQ ID NO: 924) |
| HSPA12B | NM_052970.4 | GAAAGGGCAGTAG ATCTCTAATGTGGA GGTGGGAACATTAT TGTGGTGGAGGCA ATTATGAGGGTAGC ATTTCTTTCGAGAC AAAACACCCGTCTG GGAA (SEQ ID NO: 925) | TCCACCACAATA ATGTTCCCACCTC CACATTAGAGAT CTACTGCC (SEQ ID NO: 926) | TTCCCAGACGGG TGTTTTGTCTCG AAAGAAATGCTA CCCTCATAATTG CC (SEQ ID NO: 927) |
| HSPA9 | NM_004134.4 | TTCAAGAGAGAGA CAGGGGTTGATTTG | TGAAGTGCCATG TTGTCTTTAGTCA | CAGATGAGGAG AGTTCACATTTA |

TABLE 1-continued

| Gene | GenBank Accession No. | Target Sequence | Capture Probe Sequence | Reporter Probe Sequence |
|---|---|---|---|---|
| | | ACTAAAGACAACA TGGCACTTCAGAGG GTACGGGAAGCTG CTGAAAAGGCTAA ATGTGAACTCTCCT CATCTG (SEQ ID NO: 928) | AATCAACCCCTGT CTCTCTCTTGAA (SEQ ID NO: 929) | GCCTTTTCAGCA GCTTCCCGTACC CTC (SEQ ID NO: 930) |
| HSPB8 | NM_014365.2 | CAGATTTAGTGCAA GTAAAATGTTAGAG GGTGCGGGGGTGA GGACTGACCACAG ATTCCCTGGATAGT GTAGTGGTAGATTT CTCCACAGGATAGC GCAA (SEQ ID NO: 931) | GGTCAGTCCTCAC CCCCGCACCCTCT AACATTTTACTTG CACTAAATCTG (SEQ ID NO: 932) | TTGCGCTATCCT GTGGAGAAATCT ACCACTACACTA TCCAGGGAATCT GT (SEQ ID NO: 933) |
| HTRA1 | NM_002775.4 | TTGCAATCCCATCT GATAAGATTAAAA AGTTCCTCACGGAG TCCCATGACCGACA GGCCAAAGGAAAA GCCATCACCAAGA AGAAGTATATTGGT ATCCG (SEQ ID NO: 934) | GTCATGGGACTC CGTGAGGAACTT TTTAATCTTATCA GATGGGATTGCA A (SEQ ID NO: 935) | ATACCAATATAC TTCTTCTTGGTG ATGGCTTTTCCT TTGGCCTGTCG (SEQ ID NO: 936) |
| HYOU1 | NM_006389.3 | CAGGTTGCTGGGGA GTTTCCACTCTTCT CTGGTGATTGTTCC TTCCCTCCCTTCCTC TCCCACCATGCGAT GAGCATCCTTTCAG GCCAGTGTCTGCAG A (SEQ ID NO: 937) | GGAGGGAAGGAA CAATCACCAGAG AAGAGTGGAAAC TCCCCAGCAACCT G (SEQ ID NO: 938) | CAGACACTGGCC TGAAAGGATGCT CATCGCATGGTG GGAGAGGAAG (SEQ ID NO: 939) |
| ICAM1 | NM_000201.1 | GAAATACTGAAACT TGCTGCCTATTGGG TATGCTGAGGCCCA CAGACTTACAGAA GAAGTGGCCCTCCA TAGACATGTGTAGC ATCAAAACACAAA GGCC (SEQ ID NO: 940) | TAAGTCTGTGGG CCTCAGCATACCC AATAGGCAGCAA GTTTCAGTATTTC (SEQ ID NO: 941) | GGCCTTTGTGTT TTGATGCTACAC ATGTCTATGGAG GGCCACTTCTTC TG (SEQ ID NO: 942) |
| ID1 | NM_002165.2 | CTGCCCCAGAACCG CAAGGTGAGCAAG GTGGAGATTCTCCA GCACGTCATCGACT ACATCAGGGACCTT CAGTTGGAGCTGAA CTCGGAATCCGAAG TTG (SEQ ID NO: 943) | ATGACGTGCTGG AGAATCTCCACCT TGCTCACCTTGCG GTTCTG (SEQ ID NO: 944) | CAACTTCGGATT CCGAGTTCAGCT CCAACTGAAGGT CCCTGATGTAGT CG (SEQ ID NO: 945) |
| ID2 | NM_002166.4 | CGGATATCAGCATC CTGTCCTTGCAGGC TTCTGAATTCCCTT CTGAGTTAATGTCA AATGACAGCAAAG CACTGTGTGGCTGA ATAAGCGGTGTTCA TGA (SEQ ID NO: 946) | TAACTCAGAAGG GAATTCAGAAGC CTGCAAGGACAG GATGCTGATATCC G (SEQ ID NO: 947) | TCATGAACACCG CTTATTCAGCCA CACAGTGCTTTG CTGTCATTTGAC AT (SEQ ID NO: 948) |
| ID3 | NM_002167.3 | AGGAAGCCTGTTTG CAATTTAAGCGGGC TGTGAACGCCCAGG GCCGGCGGGGGCA GGGCCGAGGCGGG CCATTTTGAATAAA GAGGCGTGCCTTCC AGGC (SEQ ID NO: 949) | CCGCCGGCCCTG GGCGTTCACAGC CCGCTTAAATTGC AAACAG (SEQ ID NO: 950) | CCTCTTTATTCA AAATGGCCCGCC TCGGCCCTGCCC (SEQ ID NO: 951) |

TABLE 1-continued

| Gene | GenBank Accession No. | Target Sequence | Capture Probe Sequence | Reporter Probe Sequence |
| --- | --- | --- | --- | --- |
| IDS | NM_000202.4 | GGGAAGACGTCCA AGCCTTAAACATCA GTGTGCCGTATGGT CCAATTCCTGTGGA CTTTCAGCGGAAAA TCCGCCAGAGCTAC TTTGCCTCTGTGTC ATA (SEQ ID NO: 952) | AGGAATTGGACC ATACGGCACACT GATGTTTAAGGCT TGGACGTCTTCCC (SEQ ID NO: 953) | TATGACACAGAG GCAAAGTAGCTC TGGCGGATTTTC CGCTGAAAGTCC AC (SEQ ID NO: 954) |
| IER3 | NM_003897.2 | TCAACTCCGTCTGT CTACTGTGTGAGAC TTCGGCGGACCATT AGGAATGAGATCC GTGAGATCCTTCCA TCTTCTTGAAGTCG CCTTTAGGGTGGCT ACG (SEQ ID NO: 955) | TCATTCCTAATGG TCCGCCGAAGTCT CACACAGTAGAC AGACGGAGTTGA (SEQ ID NO: 956) | CGTAGCCACCCT AAAGGCGACTTC AAGAAGATGGA AGGATCTCACGG ATC (SEQ ID NO: 957) |
| IF135 | NM_005533.3 | TGCCCTCTGCTTGC GGGCTCTGCTCTGA TCACCTTTGATGAC CCCAAAGTGGCTGA GCAGGTGCTGCAAC AAAAGGAGCACAC GATCAACATGGAG GAGT (SEQ ID NO: 958) | ACTTTGGGGTCAT CAAAGGTGATCA GAGCAGAGCCCG CAAGCAGAG (SEQ ID NO: 959) | TTGATCGTGTGC TCCTTTTGTTGC AGCACCTGCTCA GCC (SEQ ID NO: 960) |
| IF144L | NM_006820.2 | ATCTCTGCCATTTA TGTTGTGTGACACT ATGGGGCTAGATG GGGCAGAAGGAGC AGGACTGTGCATGG ATGACATTCCCCAC ATCTTAAAAGGTTG TATG (SEQ ID NO: 961) | CTTCTGCCCCATC TAGCCCCATAGT GTCACACAACAT AAATGGCAGAGA T (SEQ ID NO: 962) | CATACAACCTTT TAAGATGTGGGG AATGTCATCCAT GCACAGTCCTGC TC (SEQ ID NO: 963) |
| IFI6 | NM_002038.3 | GGGGTGGAGGCAG GTAAGAAAAAGTG CTCGGAGAGCTCGG ACAGCGGCTCCGG GTTCTGGAAGGCCC TGACCTTCATGGCC GTCGGAGGAGGAC TCGCAG (SEQ ID NO: 964) | GAGCCGCTGTCC GAGCTCTCCGAG CACTTTTTCTTAC CTG (SEQ ID NO: 965) | CGACGGCCATGA AGGTCAGGGCCT TCCAGAACCCG (SEQ ID NO: 966) |
| IFIH1 | NM_022168.2 | GCTTGGGAGAACCC TCTCCCTTCTCTGA GAAAGAAAGATGT CGAATGGGTATTCC ACAGACGAGAATTT CCGCTATCTCATCT CGTGCTTCAGGGCC AGG (SEQ ID NO: 967) | ACCCATTCGACAT CTTTCTTTCTCAG AGAAGGGAGAGG GTTCTCCCAAGC (SEQ ID NO: 968) | CCTGGCCCTGAA GCACGAGATGA GATAGCGGAAAT TCTCGTCTGTGG AAT (SEQ ID NO: 969) |
| IFIT1 | NM_001548.3 | GAGAAAGGCATTA GATCTGGAAAGCTT GAGCCTCCTTGGGT TCGTCTACAAATTG GAAGGAAATATGA ATGAAGCCCTGGA GTACTATGAGCGGG CCCTG (SEQ ID NO: 970) | TGTAGACGAACC CAAGGAGGCTCA AGCTTTCCAGATC TAATGCCTTTCTC (SEQ ID NO: 971) | CAGGGCCCGCTC ATAGTACTCCAG GGCTTCATTCAT ATTTCCTTCCAA TT (SEQ ID NO: 972) |
| IFIT2 | NM_001547.4 | TGCATCCCATAGAG GTTAGTCCTGCATA | ATGAACTTAGCA CATTACTGGCTAT | GCGATGGGGGAT ACTGAGCCCTAT |

TABLE 1-continued

| Gene | GenBank Accession No. | Target Sequence | Capture Probe Sequence | Reporter Probe Sequence |
|---|---|---|---|---|
| | | GCCAGTAATGTGCT AAGTTCATCCAAAA GCTGGCGGACCAA AGTCTAAATAGGGC TCAGTATCCCCCAT CGC (SEQ ID NO: 973) | GCAGGACTAACC TCTATGGGATGC A (SEQ ID NO: 974) | TTAGACTTTGGT CCGCCAGCTTTT GG (SEQ ID NO: 975) |
| IFIT3 | NM_001549.4 | GAAGAACAAATCA GCCTGGTCACCAGC TTTTCGGAACAGCA GAGACACAGAGGG CAGTCATGAGTGAG GTCACCAAGAATTC CCTGGAGAAAATCC TTCC (SEQ ID NO: 976) | CTGTGTCTCTGCT GTTCCGAAAAGC TGGTGACCAGGC TGATTTGT (SEQ ID NO: 977) | GATTTTCTCCAG GGAATTCTTGGT GACCTCACTCAT GACTGCCCT (SEQ ID NO: 978) |
| IFITM1 | NM_003641.3 | CCTGTTACTGGTAT TCGGCTCTGTGACA GTCTACCATATTAT GTTACAGATAATAC AGGAAAAACGGGG TTACTAGTAGCCGC CCATAGCCTGCAAC CTT (SEQ ID NO: 979) | TCTGTAACATAAT ATGGTAGACTGT CACAGAGCCGAA TACCAGTAACAG G (SEQ ID NO: 980) | AAGGTTGCAGGC TATGGGCGGCTA CTAGTAACCCCG TTTTTCCTGTATT A (SEQ ID NO: 981) |
| IGFBP5 | NM_000599.3 | AATGGGTTGCAAA ATAGAAATGAGCTT AATCCAGGCCGCA GAGCCAGGGAAGG TGAGTAACTTTAGG AGGGTGCTAGACTT TAGAAGCCAGATA GGAAGA (SEQ ID NO: 982) | TCCCTGGCTCTGC GGCCTGGATTAA GCTCATTTCTATT TTGCAACCCATT (SEQ ID NO: 983) | TCTTCCTATCTG GCTTCTAAAGTC TAGCACCCTCCT AAAGTTACTCAC CT (SEQ ID NO: 984) |
| IGSF3 | NM_001542.2 | AGTGGCTGTGAGAC CTCATTGCGCATTG TCTACTGGAGCTTT AGTCTTCTGAGACG GAGGAAAACTGCT GAATACTCTGGATT CATCTATGTCTACA ATG (SEQ ID NO: 985) | AGAAGACTAAAG CTCCAGTAGACA ATGCGCAATGAG GTCTCACAGCCA CT (SEQ ID NO: 986) | CATTGTAGACAT AGATGAATCCAG AGTATTCAGCAG TTTTCCTCCGTCT C (SEQ ID NO: 987) |
| IK | NM_006083.3 | GTCCAAATTCTTGG GTGGTGACATGGA ACACACCCATTTGG TGAAAGGCTTGGAT TTTGCTCTGCTTCA AAAGGTACGAGCT GAGATTGCCAGCA AAGAG (SEQ ID NO: 988) | AGCCTTTCACCAA ATGGGTGTGTTCC ATGTCACCACCC AAGAATTTGGAC (SEQ ID NO: 989) | CTCTTTGCTGGC AATCTCAGCTCG TACCTTTTGAAG CAGAGCAAAATC CA (SEQ ID NO: 990) |
| IL10 | NM_000572.2 | AAGGATCAGCTGG ACAACTTGTTGTTA AAGGAGTCCTTGCT GGAGGACTTTAAG GGTTACCTGGGTTG CCAAGCCTTGTCTG AGATGATCCAGTTT TACC (SEQ ID NO: 991) | AAGTCCTCCAGC AAGGACTCCTTTA ACAACAAGTTGT CCAGCTGATCCTT (SEQ ID NO: 992) | GGTAAAACTGGA TCATCTCAGACA AGGCTTGGCAAC CCAGGTAACCCT TA (SEQ ID NO: 993) |
| IL12A | NM_000882.2 | CTTTCTAGATCAAA ACATGCTGGCAGTT ATTGATGAGCTGAT GCAGGCCCTGAATT TCAACAGTGAGACT GTGCCACAAAAATC CTCCCTTGAAGAAC CG (SEQ ID NO: 994) | GGGCCTGCATCA GCTCATCAATAA CTGCCAGCATGTT TTGATCTAGAAA G (SEQ ID NO: 995) | CGGTTCTTCAAG GGAGGATTTTTG TGGCACAGTCTC ACTGTTGAAATT CA (SEQ ID NO: 996) |

TABLE 1-continued

| Gene | GenBank Accession No. | Target Sequence | Capture Probe Sequence | Reporter Probe Sequence |
|---|---|---|---|---|
| IL13RA1 | NM_001560.2 | TCTGCACTGGAAGAAGTACGACATCTATGAGAAGCAAACCAAGGAGGAAACCGACTCTGTAGTGCTGATAGAAAACCTGAAGAAAGCCTCTCAGTGATGG (SEQ ID NO: 997) | TTTCCTCCTTGGTTTGCTTCTCATAGATGTCGTACTTCTTCCAGTGCAGA (SEQ ID NO: 998) | CCATCACTGAGAGGCTTTCTTCAGGTTTTCTATCAGCACTACAGAGTCGG (SEQ ID NO: 999) |
| IL16 | NM_004513.4 | GGCATCTCCAACATCATCATCCAACGAAGACTCAGCTGCAAATGGTTCTGCTGAAACATCTGCCTTGGACACAGGGTTCTCGCTCAACCTTTCAGAGCTG (SEQ ID NO: 1000) | CAGAACCATTTGCAGCTGAGTCTTCGTTGGATGATGATGTTGGAGATGCC (SEQ ID NO: 1001) | CAGCTCTGAAAGGTTGAGCGAGAACCCTGTGTCCAAGGCAGATGTTTCAG (SEQ ID NO: 1002) |
| IL17RB | NM_018725.3 | TCAATTTTGATGAATGTAAGCTGGGTACTCCGGGCAGATGCCAGCATCCGCTTGTTGAAGGCCACCAAGATTTGTGTGACGGGCAAAAGCAACTTCCAGT (SEQ ID NO: 1003) | CGGATGCTGGCATCTGCCCGGAGTACCCAGCTTACATTCATCAAAATTGA (SEQ ID NO: 1004) | ACTGGAAGTTGCTTTTTGCCCGTCACACAAATCTTGGTGGCCTTCAACAAG (SEQ ID NO: 1005) |
| IL4I1 | NM_172374.1 | CAAGGGCACCACTAACAAGGACAAAGCCACCATCATTCACCTTGATTCCGCACATGCCCAACGATGACTTCTGTCCTGGGCTAACCATAAAGGCCATGGG (SEQ ID NO: 1006) | CGGAATCAAGGTGAATGATGGTGGCTTTGTCCTTGTTAGTGGTGC (SEQ ID NO: 1007) | CTTTATGGTTAGCCCAGGACAGAAGTCATCGTTGGGCATGTG (SEQ ID NO: 1008) |
| IL6 | NM_000600.1 | TGACAAACAAATTCGGTACATCCTCGACGGCATCTCAGCCCTGAGAAAGGAGACATGTAACAAGAGTAACATGTGTGAAAGCAGCAAAGAGGCACTGGCA (SEQ ID NO: 1009) | CCTTTCTCAGGGCTGAGATGCCGTCGAGGATGTACCGAATTTGTTTGTCA (SEQ ID NO: 1010) | TGCCAGTGCCTCTTTGCTGCTTTCACACATGTTACTCTTGTTACATGTCT (SEQ ID NO: 1011) |
| ING1 | NM_198219.1 | TTGGAAGTGCAGTCAGCAGATGCTGTTGTGAAGCTAATGTCACAATTATGTGCAAAGGTGTGCTTCCTGCTGTATGTGAGCTGTAAAAATGTTACGTGAA (SEQ ID NO: 1012) | CATAATTGTGACATTAGCTTCACAACAGCATCTGCTGACTGCACTTCCAA (SEQ ID NO: 1013) | TTCACGTAACATTTTTACAGCTCACATACAGCAGGAAGCACACCTTTGCA (SEQ ID NO: 1014) |
| INPP5D | NM_005541.3 | ATAATGGCCACATGGATCGAACACTCATGATGTGCCAAGTGCTGTGCTAAGTGCTTTACGAACATTCGTCATATCAGGATGACCTCGAGAGCTGAGGCTC (SEQ ID NO: 1015) | TTAGCACAGCACTTGGCACATCATGAGTGTTCGATCCATGTGGCCATTAT (SEQ ID NO: 1016) | GAGCCTCAGCTCTCGAGGTCATCCTGATATGACGAATGTTCGTAAAGCAC (SEQ ID NO: 1017) |
| IRAK1 | NM_001569.3 | CACAGCCGTGGAAGGACTGGCCCTTGG | CTGACGACGATGATGCAGAGCTGC | CATCTTCTGTCGGGCAGGGTTGAT |

TABLE 1-continued

| Gene | GenBank Accession No. | Target Sequence | Capture Probe Sequence | Reporter Probe Sequence |
|---|---|---|---|---|
| | | CAGCTCTGCATCAT CGTCGTCAGAGCCA CCGCAGATTATCAT CAACCCTGCCCGAC AGAAGATGGTCCA GAAG (SEQ ID NO: 1018) | CAAGGGCCAGTC (SEQ ID NO: 1019) | GATAATCTGCGG TGGCT (SEQ ID NO: 1020) |
| IRAK2 | NM_001570.3 | GTGTTGGCCGAGGT CCTCACGGGCATCC CTGCAATGGATAAC AACCGAAGCCCGG TTTACCTGAAGGAC TTACTCCTCAGTGA TATTCAAGCAGCA CCG (SEQ ID NO: 1021) | CTTCGGTTGTTAT CCATTGCAGGGA TGCCCGTGAGGA CCTCGG (SEQ ID NO: 1022) | CGGTGCTGCTTG GAATATCACTGA GGAGTAAGTCCT TCAGGTAAACCG GG (SEQ ID NO: 1023) |
| IRAK3 | NM_007199.1 | AGGTAAATATAGAT CCTTCTTCAGAAGC TCCAGGGCATTCTT GCAGGAGCAGGCC AGTGGAGAGCAGC TGTTCCTCCAAATT TTCCTGGGATGAAT ATGA (SEQ ID NO: 1024) | GCTCCTGCAAGA ATGCCCTGGAGC TTCTGAAGAAGG ATCTATATTTACC T (SEQ ID NO: 1025) | TCATATTCATCC CAGGAAAATTTG GAGGAACAGCT GCTCTCCACTGG CCT (SEQ ID NO: 1026) |
| IRAK4 | NM_016123.1 | GAATTCTCCTTGTA AGCCTTGAAGAAGT ATGTGAGAGGGCC ACATTGGCTAAAAC CTAAAGGTGGCCTC TAGGAGATGAGAC CTACCTTCCAGTTG TCAG (SEQ ID NO: 1027) | AGCCAATGTGGC CCTCTCACATACT TCTTCAAGGCTTA CAAGGAGAATTC (SEQ ID NO: 1028) | CTGACAACTGGA AGGTAGGTCTCA TCTCCTAGAGGC CACCTTTAGGTT TT (SEQ ID NO: 1029) |
| IRF1 | NM_002198.1 | CTGTGCGAGTGTAC CGGATGCTTCCACC TCTCACCAAGAACC AGAGAAAAGAAAG AAAGTCGAAGTCC AGCCGAGATGCTA AGAGCAAGGCCAA GAGGAA (SEQ ID NO: 1030) | TTTTCTCTGGTTC TTGGTGAGAGGT GGAAGCATCCGG TACACTCGCACA G (SEQ ID NO: 1031) | TTCCTCTTGGCC TTGCTCTTAGCA TCTCGGCTGGAC TTCGACTTTCTTT C (SEQ ID NO: 1032) |
| IRF4 | NM_002460.1 | GGGCACTGTTTAAA GGAAAGTTCCGAG AAGGCATCCGACAA GCCGGACCCTCCCA CCTGGAAGACGCG CCTGCGGTGCGCTT TGAACAAGAGCAA TGACTT (SEQ ID NO: 1033) | AGGGTCCGGCTT GTCGATGCCTTCT CGGAACTTTCCTT TAAACAGTGCCC (SEQ ID NO: 1034) | TTGTTCAAAGCG CACCGCAGGCGC GTCTTCCAGGTG GG (SEQ ID NO: 1035) |
| ISG15 | NM_005101.3 | CCCGGCAGCACGGT CCTGCTGGTGGTGG ACAAATGCGACGA ACCTCTGAGCATCC TGGTGAGGAATAA CAAGGGCCGCAGC AGCACCTACGAGGT ACGGC (SEQ ID NO: 1036) | CTCAGAGGTTCGT CGCATTTGTCCAC CACCAGCAGGAC (SEQ ID NO: 1037) | TGCTGCTGCGGC CCTTGTTATTCCT CACCAGGATG (SEQ ID NO: 1038) |
| ISY1 | NM_020701.2 | GGCAAAACATCAG TGTCTGTGGGTAGT TGGAATCTTCAGTT CCTGTGAGCGTCGG CGTCTTCTGGGCCT GTGGAGTTCTTGG ACAGGGGCCGCGG GGCT (SEQ ID NO: 1039) | GCTCACAGGAAC TGAAGATTCCAA CTACCCACAGAC ACTGATGTTTTGC C (SEQ ID NO: 1040) | CCCCTGTCCAAG AAACTCCACAGG CCCAGAAGACGC CGAC (SEQ ID NO: 1041) |

TABLE 1-continued

| Gene | GenBank Accession No. | Target Sequence | Capture Probe Sequence | Reporter Probe Sequence |
|---|---|---|---|---|
| ITGA9 | NM_002207.2 | CATGTCTCCAACCTCCTTTGTATATGGCGAGTCCGTGGACGCAGCCAACTTCATTCAGCTGGATGACCTGGAGTGTCACTTTCAGCCCATCAATATCACC (SEQ ID NO: 1042) | AGTTGGCTGCGTCCACGGACTCGCCATATACAAAGGAGGTTGGAGACATG (SEQ ID NO: 1043) | GGTGATATTGATGGGCTGAAAGTGACACTCCAGGTCATCCAGCTGAATGA (SEQ ID NO: 1044) |
| ITGAV | NM_002210.2 | TTTCTTCCGATTCCAAACTGGGAGCACAAGGAGAACCCTGAGACTGAAGAAGATGTTGGGCCAGTTGTTCAGCACATCTATGAGCTGAGAAACAATGGTC (SEQ ID NO: 1045) | TCTTCAGTCTCAGGGTTCTCCTTGTGCTCCCAGTTTGGAATCGGAAGAAA (SEQ ID NO: 1046) | GACCATTGTTTCTCAGCTCATAGATGTGCTGAACAACTGGCCCAACATCT (SEQ ID NO: 1047) |
| ITGAX | NM_000887.3 | CCCCTCAGCCTGTTGGCTTCTGTTCACCAGCTGCAAGGGTTTACATACACGGCCACCGCCATCCAAAATGTCGTGCACCGATTGTTCCATGCCTCATATG (SEQ ID NO: 1048) | GTGTATGTAAACCCTTGCAGCTGGTGAACAGAAGCCAACAGGCTGAGGG (SEQ ID NO: 1049) | CATATGAGGCATGGAACAATCGGTGCACGACATTTTGGATGGCGGTGGCC (SEQ ID NO: 1050) |
| ITGB2 | NM_000211.2 | CATCGACCTGTACTATCTGATGGACCTCTCCTACTCCATGCTTGATGACCTCAGGAATGTCAAGAAGCTAGGTGGCGACCTGCTCCGGGCCCTCAACGAG (SEQ ID NO: 1051) | GGTCATCAAGCATGGAGTAGGAGAGGTCCATCAGATAGTAC (SEQ ID NO: 1052) | CGGAGCAGGTCGCCACCTAGCTTCTTGACATTCCTGA (SEQ ID NO: 1053) |
| ITPKB | NM_002221.3 | GTGGCCTCCTGGCATCATTTGTTATTGCCTCTGAAACAAGCCTTACTGCCTGGAGGGCTTAGATTCCTGCTTCTCCAATGTAGTGTGGGTATCTTGTAGG (SEQ ID NO: 1054) | GGCAGTAAGGCTTGTTTCAGAGGCAATAACAAATGATGCCAGGAGGCCAC (SEQ ID NO: 1055) | CCTACAAGATACCCACACTACATTGGAGAAGCAGGAATCTAAGCCCTCCA (SEQ ID NO: 1056) |
| JAK1 | NM_002227.1 | GAGAACACCAAGCTCTGGTATGCTCCAAATCGCACCATCACCGTTGATGACAAGATGTCCCTCCGGCTCCACTACCGGATGAGGTTCTATTTCACCAATT (SEQ ID NO: 1057) | TCATCAACGGTGATGGTGCGATTTGGAGCATACCAGAGCTTGGTGTTCTC (SEQ ID NO: 1058) | AATTGGTGAAATAGAACCTCATCCGGTAGTGGAGCCGGAGGGACATCTTG (SEQ ID NO: 1059) |
| JAK2 | NM_004972.2 | CTCCTCCCGCGACGGCAAATGTTCTGAAAAAGACTCTGCATGGGAATGGCCTGCCTTACGATGACAGAAATGGAGGGAACATCCACCTCTTCTATATATC (SEQ ID NO: 1060) | GCCATTCCCATGCAGAGTCTTTTTCAGAACATTTGCCGTCGCGGGAGGAG (SEQ ID NO: 1061) | GATATATAGAAGAGGTGGATGTTCCCTCCATTTCTGTCATCGTAAGGCAG (SEQ ID NO: 1062) |
| JAK3 | NM_000215.2 | GTGCTGCTGAAGGTCATGGATGCCAAGC | AATGACTCCATGCAGTTCTTGTGCT | CGGTACGACACTTGGCTCATCAAG |

TABLE 1-continued

| Gene | GenBank Accession No. | Target Sequence | Capture Probe Sequence | Reporter Probe Sequence |
|---|---|---|---|---|
| | | ACAAGAACTGCAT GGAGTCATTCCTGG AAGCAGCGAGCTT GATGAGCCAAGTGT CGTACCGGCATCTC GTGC (SEQ ID NO: 1063) | TGGCATCCATGA CCTTCAGCAG (SEQ ID NO: 1064) | CTCGCTGCTTCC AGG (SEQ ID NO: 1065) |
| KCNJ1 | NM_153766.1 | GGAGGTGCTTTGGG GCTACCGTTTTGCT CCCATAGTATCCAA GACAAAGGAAGGG AAATACCGAGTGG ATTTCCATAACTTT AGCAAGACAGTGG AAGTG (SEQ ID NO: 1066) | CCTTTGTCTTGGA TACTATGGGAGC AAAACGGTAGCC CCAAAGCACCTC C (SEQ ID NO: 1067) | CACTTCCACTGT CTTGCTAAAGTT ATGGAAATCCAC TCGGTATTTCCC TT (SEQ ID NO: 1068) |
| KCNK12 | NM_022055.1 | CCAGGGGCTCTACC GCCTGGGCAACTTC CTCTTCATCCTGCT CGGCGTGTGCTGCA TTTACTCGCTCTTC AACGTCATCTCCAT CCTCATCAAGCAGG TG (SEQ ID NO: 1069) | ACACGCCGAGCA GGATGAAGAGGA AGTTGCCCAGGC GGTA (SEQ ID NO: 1070) | CACCTGCTTGAT GAGGATGGAGA TGACGTTGAAGA GCGAGTAAATGC AGC (SEQ ID NO: 1071) |
| KCNMA1 | NM_001014797.1 | TATTGAGTACCTCA AGCGGGAATGGGA GACGCTTCATAACT TCCCCAAAGTGTCC ATATTGCCTGGTAC GCCATTAAGTCGGG CTGATTTAAGGGCT GTC (SEQ ID NO: 1072) | CTTTGGGGAAGTT ATGAAGCGTCTC CCATTCCCGCTTG AGGTACTCAATA (SEQ ID NO: 1073) | GACAGCCCTTAA ATCAGCCCGACT TAATGGCGTACC AGGCAATATGGA CA (SEQ ID NO: 1074) |
| KCNQ3 | NM_004519.2 | GTATGAGACTGTCT CGGGAGACTGGCTT CTGTTACTGGAGAC ATTTGCTATTTTCA TCTTTTGGAGCCGAG TTTGCTTTGAGGAT CTGGGCTGCTGGAT GT (SEQ ID NO: 1075) | TAGCAAATGTCTC CAGTAACAGAAG CCAGTCTCCCGA GACAGTCTCATA C (SEQ ID NO: 1076) | ACATCCAGCAGC CCAGATCCTCAA AGCAAACTCGGC TCCAAAGATGAA AA (SEQ ID NO: 1077) |
| KCP | NM_001135914.1 | TATGCCAATGGGCA GAACTTCACGGATG CAGACAGCCCTTGC CATGCCTGCCACTG TCAGGATGGAACTG TGACATGCTCCTTG GTTGACTGCCCTCC CA (SEQ ID NO: 1078) | CAGGCATGGCAA GGGCTGTCTGCAT CCGTGAAGTTCTG (SEQ ID NO: 1079) | CAGTCAACCAAG GAGCATGTCACA GTTCCATCCTGA CAGTGG (SEQ ID NO: 1080) |
| KDM4C | NM_015061.2 | ATTCTCCACCCAAT GCCTTCCTTGAAGA GGATGGAACAAGT CTCCTTATTTCCTGT GCAAAGTGCTGCGT ACGGGTTCATGCAA GTTGTTATGGTATT CC (SEQ ID NO: 1081) | AATAAGGAGACT TGTTCCATCCTCT TCAAGGAAGGCA TTGGGTGGAGAA T (SEQ ID NO: 1082) | GGAATACCATAA CAACTTGCATGA ACCCGTACGCAG CACTTTGCACAG GA (SEQ ID NO: 1083) |
| KDR | NM_002253.2 | CAATCACACAATTA AGCGGGGCATGT ACTGACGATTATGG AAGTGAGTGAAAG AGACACAGGAAAT TACACTGTCATCCT TACCAATCCCATTT CAAAG (SEQ ID NO: 1084) | CACTCACTTCCAT AATCGTCAGTAC ATGCCCCGCTTTA ATTGTGTGATTG (SEQ ID NO: 1085) | CTTTGAAATGGG ATTGGTAAGGAT GACAGTGTAATT TCCTGTGTCTCTT T (SEQ ID NO: 1086) |
| KIAA1147 | NM_001080392.1 | CCAGGTGGGAGTG GAATTCAGGTTTGG | TTTTGCATGGATA CCAACGAGCCCC | TGCTGAGCCTAC AGAATTGAAAAT |

TABLE 1-continued

| Gene | GenBank Accession No. | Target Sequence | Capture Probe Sequence | Reporter Probe Sequence |
|---|---|---|---|---|
| | | GGCTCGTTGGTATC CATGCAAAATATGA CAAAGGCCTGTTCA AGAGGGCATTTTCA ATTCTGTAGGCTCA GCA (SEQ ID NO: 1087) | AAACCTGAATTC CACTCCCACCTGG (SEQ ID NO: 1088) | GCCCTCTTGAAC AGGCCTTTGTCA TA (SEQ ID NO: 1089) |
| KIAA1274 | NM_014431.2 | AGGAAAGCCTGTCT TTGGTTAGGCTCGT GTACTTCTGCAGGA AAAAAAAAAAAGG ATGTGTCATTGGTC ATGATATTTGAAAA GGGGAGGAGGCCG AAGT (SEQ ID NO: 1090) | TTTTTTTTTCCTG CAGAAGTACACG AGCCTAACCAAA GACAGGCTTTCCT (SEQ ID NO: 1091) | ACTTCGGCCTCC TCCCCTTTTCAA ATATCATGACCA ATGACACATCCT TT (SEQ ID NO: 1092) |
| KIF11 | NM_004523.3 | CAGACCATTTAATT TGGCAGAGCGGAA AGCTAGCGCCCATT CAATAGTAGAATGT GATCCTGTACGAAA AGAAGTTAGTGTAC GAACTGGAGGATT GGCT (SEQ ID NO: 1093) | CTACTATTGAATG GGCGCTAGCTTTC CGCTCTGCCAAAT TAAATGGTCTG (SEQ ID NO: 1094) | AGCCAATCCTCC AGTTCGTACACT AACTTCTTTTCG TACAGGATCACA TT (SEQ ID NO: 1095) |
| KIF14 | NM_014875.2 | TGATCGAGCAATCC AGTCACTTACTATT CAGACTGCATGTGC TTTTGAGCAGCTAG TAGTGCTAATGAAA CACTGGCTGAGTGA TTTACTGCCTTGTA CC (SEQ ID NO: 1096) | GCTCAAAAGCAC ATGCAGTCTGAA TAGTAAGTGACT GGATTGCTCGATC A (SEQ ID NO: 1097) | GGTACAAGGCA GTAAATCACTCA GCCAGTGTTTCA TTAGCACTACTA GCT (SEQ ID NO: 1098) |
| KIF15 | NM_020242.2 | AACCACCTCAAGTT TCTGATGAACATTC TGCATCCATATACA CCCTGTGACAGTCA GCAGTCTGCTATTA AGTGGCCTACTTCA AGGCTTTGAATCAA CT (SEQ ID NO: 1099) | TCACAGGGTGTA TATGGATGCAGA ATGTTCATCAGA AACTTGAGGTGG TT (SEQ ID NO: 1100) | AGTTGATTCAAA GCCTTGAAGTAG GCCACTTAATAG CAGACTGCTGAC TG (SEQ ID NO: 1101) |
| KIF18A | NM_031217.3 | CATAGACTTGCAAT GTTGAAAACTCGTC GCTCCTACCTGGAG AAAAGGAGGGAGG AGGAATTGAAGCA ATTTGATGAGAATA CTAATTGGCTCCAT CGTG (SEQ ID NO: 1102) | CTCCTTTTCTCCA GGTAGGAGCGAC GAGTTTTCAACAT TGCAAGTCTATG (SEQ ID NO: 1103) | CACGATGGAGCC AATTAGTATTCT CATCAAATTGCT TCAATTCCTCCT CC (SEQ ID NO: 1104) |
| KIF18B | NM_001080443.1 | TCCAAGCAGCCAAC CTCCTGACGCCCGA CATGATCACAGAGT TTGAGACCCTACAG CAGCTGGTGCAAG AGGAAAAAATTGA GCCTGGGGCAGAG GCCTT (SEQ ID NO: 1105) | GGTCTCAAACTCT GTGATCATGTCG GGCGTCAGGAGG TTGG (SEQ ID NO: 1106) | CCAGGCTCAATT TTTTCCTCTTGCA CCAGCTGCTGTA G (SEQ ID NO: 1107) |
| KIF20A | NM_005733.2 | GCAGGCTTCCCTAT CTGATTGGCCGAAC GAACGCAGCGCGT AATTTAAAATATTG TATCTGTAACAAAG CTGCACCTCGTGGG CGGAGTTGTGCTCT GCG (SEQ ID NO: 1108) | TTTTAAATTACGC GCTGCGTTCGTTC GGCCAATCAGAT AGGGAAGCCTGC (SEQ ID NO: 1109) | CGCAGAGCACA ACTCCGCCCACG AGGTGCAGCTTT GTTACAGATACA ATA (SEQ ID NO: 1110) |

TABLE 1-continued

| Gene | GenBank Accession No. | Target Sequence | Capture Probe Sequence | Reporter Probe Sequence |
|------|------------------------|-----------------|-------------------------|--------------------------|
| KIF23 | NM_138555.1 | TGTGTGGATGATTTCTCGAAAGCCATGCCAGAAGCAGTCTTCCAGGTCATCTTGTAGAACTCCAGCTTTGTTGAAAATCACGGACCTCAGCTACATCATA (SEQ ID NO: 1111) | ATGACCTGGAAGACTGCTTCTGGCATGGCTTTCGAGAAATCATCCACACA (SEQ ID NO: 1112) | TATGATGTAGCTGAGGTCCGTGATTTTCAACAAAGCTGGAGTTCTACAAG (SEQ ID NO: 1113) |
| KIF2C | NM_006845.3 | CCTGCTCTAACGGGGCGCTGATTCCAGGCAATTTATCCAAGGAAGAGGAGGAACTGTCTTCCCAGATGTCCAGCTTTAACGAAGCCATGACTCAGATCAG (SEQ ID NO: 1114) | CTCCTCTTCCTTGGATAAATTGCCTGGAATCAGCGCCCCGTTAGAGCAGG (SEQ ID NO: 1115) | CTGATCTGAGTCATGGCTTCGTTAAAGCTGGACATCTGGGAAGACAGTTC (SEQ ID NO: 1116) |
| KIF4A | NM_012310.3 | GGAGCAAAGCATGGACATCGAGGATCTAAAATATTGTTCAGAGCATTCTGTGAATGAGCATGAGGATGGTGATGGTGATGATGATGAGGGGGATGACGAG (SEQ ID NO: 1117) | CAGAATGCTCTGAACAATATTTTAGATCCTCGATGTCCATGCTTTGCTCC (SEQ ID NO: 1118) | CCCTCATCATCATCACCATCACCATCCTCATGCTCATTCA (SEQ ID NO: 1119) |
| KIF6 | NM_145027.4 | GGACTTCAGCATTTTGGGGAAAAGATCCAGTTTGCTCCACAAGAAAATAGGAATGAGAGAGGAAATGTCATTAGGATGCCAGGAGGCTTTTGAAATCTTC (SEQ ID NO: 1120) | CTATTTTCTTGTGGAGCAAACTGGATCTTTTCCCCAAAATGCTGAAGTCC (SEQ ID NO: 1121) | GAAGATTTCAAAAGCCTCCTGGCATCCTAATGACATTTCCTCTCTCATTC (SEQ ID NO: 1122) |
| KLHL5 | NM_015990.4 | GTGGGGAGAGATTGCTAAAAAGGAGTTTCCTTCTAGGGTGATGAAAATGTTCTGGAACTACTTATTGGGGATGATTGCACAACATGGTGAAGGTACTCAA (SEQ ID NO: 1123) | ACATTTTCATCACCCTAGAAGGAAACTCCTTTTTAGCAATCTCTCCCCAC (SEQ ID NO: 1124) | TTGAGTACCTTCACCATGTTGTGCAATCATCCCCAATAAGTAGTTCCAGA (SEQ ID NO: 1125) |
| KPNA2 | NM_002266.2 | TGATGATCCAGAAGTATTAGCAGATACCTGCTGGGCTATTTCCTACCTTACTGATGGTCCAAATGAACGAATTGGCATGGTGGTGAAAACAGGAGTTGTG (SEQ ID NO: 1126) | TAAGGTAGGAAATAGCCCAGCAGGTATCTGCTAATACTTCTGGATCATCA (SEQ ID NO: 1127) | CACAACTCCTGTTTTCACCACCATGCCAATTCGTTCATTTGGACCATCAG (SEQ ID NO: 1128) |
| KRAS | NM_033360.2 | CATGGACTGTGTCCCCACGGTCATCCAGTGTTGTCATGCATTGGTTAGTCAAAATGGGGAGGGACTAGGGCAGTTTGGATAGCTCAACAAGATACAATCT (SEQ ID NO: 1129) | GACTAACCAATGCATGACAACACTGGATGACCGTGGGGACACAGTCCATG (SEQ ID NO: 1130) | AGATTGTATCTTGTTGAGCTATCCAAACTGCCCTAGTCCCTCCCCATTTT (SEQ ID NO: 1131) |
| KYNU | NM_003937.2 | TAAGTGGGCCAAAATAGCAGCCTATGG | AAGGACGCTTCCCCACTTCATGACC | TCCTACAATGTCCTTCATAAGGCC |

TABLE 1-continued

| Gene | GenBank Accession No. | Target Sequence | Capture Probe Sequence | Reporter Probe Sequence |
|---|---|---|---|---|
| | | TCATGAAGTGGGG AAGCGTCCTTGGAT TACAGGAGATGAG AGTATTGTAGGCCT TATGAAGGACATTG TAGGA (SEQ ID NO: 1132) | ATAGGCTGCTATT TTGGCCCACTTA (SEQ ID NO: 1133) | TACAATACTCTC ATCTCCTGTAAT CC (SEQ ID NO: 1134) |
| LAMB1 | NM_002291.2 | TTGCCAGGAGCTGC TACCAAGATCCTGT TACTTTACAGCTTG CCTGTGTTTGTGAT CCTGGATACATTGG TTCCAGATGTGACG ACTGTGCCTCAGGA TA (SEQ ID NO: 1135) | AACACAGGCAAG CTGTAAAGTAAC AGGATCTTGGTA GCAGCTCCTGGC AA (SEQ ID NO: 1136) | TATCCTGAGGCA CAGTCGTCACAT CTGGAACCAATG TATCCAGGATCA CA (SEQ ID NO: 1137) |
| LAMP3 | NM_014398.3 | GGTCTCTGCCTTAT GGGTATGGGTGTCT ATAAAATCCGCCTA AGGTGTCAATCATC TGGATACCAGAGA ATCTAATTGTTGCC CGGGGGAATGAA AATA (SEQ ID NO: 1138) | TGACACCTTAGG CGGATTTTATAGA CACCCATACCCAT AAGGCAGAGACC (SEQ ID NO: 1139) | TATTTTCATTCCC CCCGGGCAACAA TTAGATTCTCTG GTATCCAGATGA T (SEQ ID NO: 1140) |
| LANCL1 | NM_006055.1 | AATGCCTATGCCTT CCTGACACTCTACA ACCTCACACAGGAC ATGAAGTACCTGTA TAGGGCCTGTAAGT TTGCTGAATGGTGC TTAGAGTATGGAGA AC (SEQ ID NO: 1141) | TACTTCATGTCCT GTGTGAGGTTGT AGAGTGTCAGGA AGGCATAG (SEQ ID NO: 1142) | GTTCTCCATACT CTAAGCACCATT CAGCAAACTTAC AGGCCCTATACA GG (SEQ ID NO: 1143) |
| LAT | NM_001014987.1 | TGTGTAATAGAATA AAGGCCTGCGTGTG TCTGTGTTGAGCGT GCGTCTGTGTGTGC CTGTGTGCGAGTCT GAGTCAGAGATTTG GAGATGTCTCTGTG TG (SEQ ID NO: 1144) | ACAGACGCACGC TCAACACAGACA CACGCAGGCCTTT ATTCTATTACACA (SEQ ID NO: 1145) | CACACAGAGAC ATCTCCAAATCT CTGACTCAGACT CGCACACAGGCA CAC (SEQ ID NO: 1146) |
| LAT2 | NM_014146.3 | TGCAGAGCTGATTA AACAGTGTTGTGAC TGTCTCATGGGAAG AGCTGGGGCCCAG AGGGACCTTGAGTC AGAAATGTTGCCAG AAAAAGTATCTCCT CCA (SEQ ID NO: 1147) | CCCCAGCTCTTCC CATGAGACAGTC ACAACACTGTTTA ATCAG (SEQ ID NO: 1148) | GAGATACTTTTT CTGGCAACATTT CTGACTCAAGGT CCCTCTGGG (SEQ ID NO: 1149) |
| LDHA | NM_005566.1 | CAGAATGGAATCTC AGACCTTGTGAAGG TGACTCTGACTTCT GAGGAAGAGGCCC GTTTGAAGAAGAGT GCAGATACACTTTG GGGGATCCAAAAG GAGC (SEQ ID NO: 1150) | TCTTCCTCAGAAG TCAGAGTCACCTT CACAAGGTCTGA GATTCCATTCTG (SEQ ID NO: 1151) | GCTCCTTTTGGA TCCCCCAAAGTG TATCTGCACTCT TCTTCAAACGGG CC (SEQ ID NO: 1152) |
| LHFPL3 | NM_199000.2 | TGTGCTTGGCTGTA TGATTTTCCCTGAT GGCTGGGACTCAG ATGAAGTAAAACG GATGTGTGGAGAA AAGACAGACAAGT ACACTCTTGGGGCT TGCTCA (SEQ ID NO: 1153) | TTACTTCATCTGA GTCCCAGCCATC AGGGAAAATCAT ACAGCCAAGCAC A (SEQ ID NO: 1154) | CCAAGAGTGTAC TTGTCTGTCTTTT CTCCACACATCC GTT (SEQ ID NO: 1155) |

TABLE 1-continued

| Gene | GenBank Accession No. | Target Sequence | Capture Probe Sequence | Reporter Probe Sequence |
|---|---|---|---|---|
| LHX2 | NM_004789.3 | TAGAGGCTTTGAGC AACTAACTAACCAC ATTTTAGGATCTCG CCTGGAAACAGAG GTAAAAAAAAGAA GTGTGCGCCCGGCT AATGCAGCGGTGTG GACC (SEQ ID NO: 1156) | TTTCCAGGCGAG ATCCTAAAATGT GGTTAGTTAGTTG CTCAAAGCCTCTA (SEQ ID NO: 1157) | ACACCGCTGCAT TAGCCGGGCGCA CACTTCTTTTTTT TACCTCTG (SEQ ID NO: 1158) |
| LIMA1 | NM_001113547.1 | AACTACATCCTGAA CTCGACGTCCTGAG GTATAATACAACAG AGCACTTTTTGAGG CAATTGAAAAACC AACCTACACTCTTC GGTGCTTAGAGAG ATCT (SEQ ID NO: 1159) | AAAGTGCTCTGTT GTATTATACCTCA GGACGTCGAGTT CAGGATGTAGTT (SEQ ID NO: 1160) | AGATCTCTCTAA GCACCGAAGAGT GTAGGTTGGTTT TTCAATTGCCTC AA (SEQ ID NO: 1161) |
| LIMD1 | NM_014240.2 | AAGGCAAGTCTCA GGAACCCATGCAG GTACATCGCTTGCA CCTGTTTTTAGCTT ATTTAATGACGGGC TTTTGGGAAGAGCT GCCCGCATACTGAG AGAC (SEQ ID NO: 1162) | TAAAAACAGGTG CAAGCGATGTAC CTGCATGGGTTCC TGAGACTTGCCTT (SEQ ID NO: 1163) | TCTCTCAGTATG CGGGCAGCTCTT CCCAAAAG C CC G TCATTAAATAAG C (SEQ ID NO: 1164) |
| LMAN2 | NM_006816.2 | CTTTTGTTGTTGGG GTCTGTGACTGCGG ATATAACTGACGGC AACAGTGAACATCT CAAGCGGGAGCAT TCGCTCATTAAGCC CTACCAAGGGGTCG GTT (SEQ ID NO: 1165) | TCACTGTTGCCGT CAGTTATATCCGC AGTCACAGACCC CAACAACAAAAG (SEQ ID NO: 1166) | CCTTGGTAGGGC TTAATGAGCGAA TGCTCCCGCTTG AGATGT (SEQ ID NO: 1167) |
| LMO2 | NM_005574.3 | AAGCATTTCTGTGT AGGTGACAGATAC CTCCTCATCAACTC TGACATAGTGTGCG AACAGGACATCTAC GAGTGGACTAAGA TCAATGGGATGATA TAGG (SEQ ID NO: 1168) | ACTATGTCAGAG TTGATGAGGAGG TATCTGTCACCTA CACAGAAATGCT T (SEQ ID NO: 1169) | CCTATATCATCC CATTGATCTTAG TCCACTCGTAGA TGTCCTGTTCGC AC (SEQ ID NO: 1170) |
| LOC643529 | XR_041961.1 | CCATTATGTCTCCA TATCAGACTCTGTT GGGTACAAGTGAC ACAGAAAGTCATCT CAAACTAGCTGAA ACACAAAAGCGCA GGAAGGCGGAAGG GAAGGC (SEQ ID NO: 1171) | ACTTTCTGTGTCA CTTGTACCCAACA GAGTCTGATATG GAGACATAATGG (SEQ ID NO: 1172) | CGCCTTCCTGCG CTTTTGTGTTTCA GCTAGTTTGAGA TG (SEQ ID NO: 1173) |
| LOXL2 | NM_002318.2 | GGTTTGCCATCCTC CTCTAGTTAAAAGT AAGGGGGAAAAGA GTAAACGCGCGACT CCAGCGCGCGGCTA CCTACGCTTGGTGC TTGCTTTCTCCAGC CAT (SEQ ID NO: 1174) | CGCGTTTACTCTT TTCCCCCTTACTT TTAACTAGAGGA GGATGGCAAACC (SEQ ID NO: 1175) | TGGAGAAAGCA AGCACCAAGCGT AGGTAGCCGCGC GCTGGAGTCG (SEQ ID NO: 1176) |
| LPCAT3 | NM_005768.5 | TGCCACCGGCAACT ACGATATCAAGTGG | TCAGAACACAAT GTGGCATTGTCCA | ATCTTTCCCTCC GTCAAAGTAGTC |

TABLE 1-continued

| Gene | GenBank Accession No. | Target Sequence | Capture Probe Sequence | Reporter Probe Sequence |
|---|---|---|---|---|
| | | ACAATGCCACATTG TGTTCTGACTTTGA AGCTGATTGGTTTG GCTGTTGACTACTT TGACGGAGGGAAA GAT (SEQ ID NO: 1177) | CTTGATATCGTAG TTGCCGGTGGCA (SEQ ID NO: 1178) | AACAGCCAAACC AATCAGCTTCAA AG (SEQ ID NO: 1179) |
| LRMP | NM_006152.2 | TCCATCAGAAAGGC TAATAAGGCCCTCT GGCTCTCTATTGCA TTCATTGTACTGTT TGCAGCTTTGATGA GCTTCCTCACAGGC CAATTATTCCAGAA GT (SEQ ID NO: 1180) | ACAATGAATGCA ATAGAGAGCCAG AGGGCCTTATTA GCCTTTCTGATGG A (SEQ ID NO: 1181) | ACTTCTGGAATA ATTGGCCTGTGA GGAAGCTCATCA AAGCTGCAAACA GT (SEQ ID NO: 1182) |
| LRP3 | NM_002333.3 | GCCAGGAGGCCTTC CGCCTCTGTGGCTC CGCCATCCCACCTG CCTTCATCTCTGCC CGCGACCATGTCTG GATTTTCTTCCACT CAGACGCCTCCAGC TC (SEQ ID NO: 1183) | GATGAAGGCAGG TGGGATGGCGGA GCCACAGAGGCG GAAG (SEQ ID NO: 1184) | CTGGAGGCGTCT GAGTGGAAGAA AATCCAGACATG GTCGCGGGCAGA (SEQ ID NO: 1185) |
| LRPPRC | NM_133259.3 | AAAATGTGAGTGTG GTACAGAGGAAAT AGGTAAGACCCCCT TATCTAGCCCTCTC GGCAGCAGCGGGG GGGTGTTACAAAG GACTAGCTGTTCAA ATATC (SEQ ID NO: 1186) | GGCTAGATAAGG GGGTCTTACCTAT TTCCTCTGTACCA CACTCACATTTT (SEQ ID NO: 1187) | GATATTTGAACA GCTAGTCCTTTG TAACACCCCCCC GCTGCTGCCGAG AG (SEQ ID NO: 1188) |
| LRRC15 | NM_001135057.2 | CTGCCTTCTCTGGC TTTCCTGCTATACA CATATTCACATGGC GCTCAAGAAGTTAG GCTCATGGCAACGT GTGTCTTTCTCTGG ACAACTGGCCCAGT TT (SEQ ID NO: 1189) | TCTTGAGCGCCAT GTGAATATGTGT ATAGCAGGAAAG CCAGAGAAGGCA G (SEQ ID NO: 1190) | AAACTGGGCCAG TTGTCCAGAGAA AGACACACGTTG CCATGAGCCTAA CT (SEQ ID NO: 1191) |
| LRRC33 | NM_198565.1 | GTGTGCCAAGACTC GAAATTCGGTCCGC ACACAACAGGACA CTTTCTCTGCCAGC TTTCAAGATGTGAT GCAGAGGCCAAGT CTGACGAATTGAAG TTTC (SEQ ID NO: 1192) | CAGAGAAAGTGT CCTGTTGTGTGCG GACCGAATTTCG AGTCTTGGCACA C (SEQ ID NO: 1193) | GAAACTTCAATT CGTCAGACTTGG CCTCTGCATCAC ATCTTGAAAGCT GG (SEQ ID NO: 1194) |
| LTBP2 | NM_000428.2 | CATCTCTCCCAGCT TAGCCTCTGGCTGT AAGCTTCGGTCATT GCCTCCATGCCCTT GCTTGGCTCAAGCA CCACCAATCGCTTT AATGCTTCAGCCAC CG (SEQ ID NO: 1195) | ATGGAGGCAATG ACCGAAGCTTAC AGCCAGAGGCTA AGCTGGGAGAGA TG (SEQ ID NO: 1196) | CGGTGGCTGAAG CATTAAAGCGAT TGGTGGTGCTTG AGCCAAGCAAG GGC (SEQ ID NO: 1197) |
| LYPD6B | NM_177964.3 | AAACTGTGTGAACG GTGAACTTTGGAGT GAAGATCAATCTTG CACTTGGTGAAGAG TGCACATTGGACCT CAAGGCGAAAGCC AGTGGTTTGCTTGG ATA (SEQ ID NO: 1198) | ACCAAGTGCAAG ATTGATCTTCACT CCAAAGTTCACC GTTCACACAGTTT (SEQ ID NO: 1199) | AAGCAAACCACT GGCTTTCGCCTT GAGGTCCAATGT GCACTCTTC (SEQ ID NO: 1200) |
| LYZ | NM_000239.2 | ATGATGGCAAAAC CCCAGGAGCAGTTA | ACTGCAGGATAA ATGACAGGCATT | ACC CTCTTTGCA CAAGCTACAGCA |

TABLE 1-continued

| Gene | GenBank Accession No. | Target Sequence | Capture Probe Sequence | Reporter Probe Sequence |
|---|---|---|---|---|
| | | ATGCCTGTCATTTA TCCTGCAGTGCTTT GCTGCAAGATAAC ATCGCTGATGCTGT AGCTTGTGCAAAGA GGGT (SEQ ID NO: 1201) | AACTGCTCCTGG GGTTTTGCCATCA T (SEQ ID NO: 1202) | TCAGCGATGTTA TCTTGCAGCAAA GC (SEQ ID NO: 1203) |
| MACROD2 | NM_080676.5 | CTATAGAGGTGACA TCACATTGCTAGAG GTAGATGCTATAGT CAATGCCGCAAATG CCAGTCTTCTTGGA GGAGGAGGTGTGG ATGGCTGTATTCAT AGA (SEQ ID NO: 1204) | CGGCATTGACTAT AGCATCTACCTCT AGCAATGTGATG TCACCTCTATAG (SEQ ID NO: 1205) | TCTATGAATACA GCCATCCACACC TCCTCCTCCAAG AAGACTGGCATT TG (SEQ ID NO: 1206) |
| MAL | NM_002371.2 | GCCTTCGCGTCCGG GTTGGGAGCTTGCT GTGTCTAACCTCCA ACTGCTGTGCTGTC TGCTAGGGTCACCT CCTGTTTGTGAAAG GGGACCTTCTTGTT CG (SEQ ID NO: 1207) | ACAGCAGTTGGA GGTTAGACACAG CAAGCTCCCAAC CCGGACGCGAAG (SEQ ID NO: 1208) | CGAACAAGAAG GTCCCCTTTCAC AAACAGGAGGT GACCCTAGCAGA CAGC (SEQ ID NO: 1209) |
| MALT1 | NM_006785.2 | AGTGTTGATGGCGT CTCTGAATCCAAGT TGCAAATCTGTGTT GAACCAACTTCCCA AAAGCTGATGCCA GGCAGCACATTGGT TTTACAGTGTGTTG CTG (SEQ ID NO: 1210) | GTTGGTTCAACAC AGATTTGCAACTT GGATTCAGAGAC GCCATCAACACT (SEQ ID NO: 1211) | CAGCAACACACT GTAAAACCAATG TGCTGCCTGGCA TCAGCTTTTGGG AA (SEQ ID NO: 1212) |
| MAML3 | NM_018717.4 | TGGAAGCCATCAAC AATTTGCCCAGTAA CATGCCACTGCCTT CAGCTTCTCCTCTT CACCAACTTGACCT GAAACCTTCTTTGC CCTTCCAGAACAGT GG (SEQ ID NO: 1213) | AGAAGCTGAAGG CAGTGGCATGTT ACTGGGCAAATT GTTGATGGCTTCC A (SEQ ID NO: 1214) | CCACTGTTCTGC AAGGGCAAAGA AGGTTTCAGGTC AAGTTGGTGAAG AGG (SEQ ID NO: 1215) |
| MAP3K1 | NM_005921.1 | ACTTCAGAGACTTC TCCAGCCAGTTGTA GACACCATCCTAGT CAAATGTGCAGATG CCAATAGCCGCACA AGTCAGCTGTCCAT ATCAACACTGTTGG AA (SEQ ID NO: 1216) | CACATTTGACTAG GATGGTGTCTAC AACTGGCTGGAG AAGTCTCTGAAG T (SEQ ID NO: 1217) | TTCCAACAGTGT TGATATGGACAG CTGACTTGTGCG GCTATTGGCATC TG (SEQ ID NO: 1218) |
| MAP3K8 | NM_005204.2 | CTGGCTACTTCAAT CTTGTTCGGGGACC ACCAACGCTTGAAT ATGGCTGAAGGAT GCCATGTTTGCTCT AAATTAAGACAGC ATTGATCTCCTGGA GGCT (SEQ ID NO: 1219) | TCAGCCATATTCA AGCGTTGGTGGT CCCCGAACAAGA TTGAAGTAGCCA G (SEQ ID NO: 1220) | AGCCTCCAGGAG ATCAATGCTGTC TTAATTTAGAGC AAACATGGCATC CT (SEQ ID NO: 1221) |
| MAP4K4 | NM_004834.3 | GATGCCTACATCAG TAGCATATATTCGA TCCAATCAGACAAT GGGCTGGGGAGAG AAGGCCATAGAGA TCCGATCTGTGGAA ACTGGTCACTTGGA TGGT (SEQ ID NO: 1222) | CCCAGCCCATTGT CTGATTGGATCG AATATATGCTACT GATGTAGGCATC (SEQ ID NO: 1223) | CAAGTGACCAGT TTCCACAGATCG GATCTCTATGGC CTTCTCTC (SEQ ID NO: 1224) |

TABLE 1-continued

| Gene | GenBank Accession No. | Target Sequence | Capture Probe Sequence | Reporter Probe Sequence |
|---|---|---|---|---|
| MAPK10 | NM_002753.2 | GTATTCATACAGCACTACTTACTTAGAGATGCTACTGTCAGTGTCCTCAGGGCTCTACCAAGACATAATGCACTGGGGTACCACATGGTCCATTTCATGT (SEQ ID NO: 1225) | CTGAGGACACTGACAGTAGCATCTCTAAGTAAGTAGTGCTGTATGAATAC (SEQ ID NO: 1226) | ACATGAAATGGACCATGTGGTACCCCAGTGCATTATGTCTTGGTAGAGCC (SEQ ID NO: 1227) |
| MAPKAPK5 | NM_003668.2 | GCGAAGAAAGATCATGACAGGCAGTTTTGAGTTCCCAGAGGAAGAGTGGAGTCAGATCTCAGAGATGGCCAAAGATGTTGTGAGGAAGCTCCTGAAGGTC (SEQ ID NO: 1228) | TCCACTCTTCCTCTGGGAACTCAAAACTGCCTGTCATGATCTTTCTTCGC (SEQ ID NO: 1229) | GACCTTCAGGAGCTTCCTCACAACATCTTTGGCCATCTCTGAGATCTGAC (SEQ ID NO: 1230) |
| MARCKS | NM_002356.5 | CCACCACCCCCACCCCCCTCCCTCCGGTGTGTGTGCCGCTGCCGCTGTTGCCGCCGCCGCTGCTGCTGCTCGCCCCGTCGTTACACCAACCCGAGGCTCT (SEQ ID NO: 1231) | CAACAGCGGCAGCGGCACACACACCGGAGGGAGGG (SEQ ID NO: 1232) | TGTAACGACGGGGCGAGCAGCAGCAGCGGCGGCG (SEQ ID NO: 1233) |
| MARCKSL1 | NM_023009.5 | CAGCTTCCCAAGTTAGGTTAGTGATGTGAAATGCTCCTGTCCCTGGCCCTACCTCCTTCCCTGTCCCCACCCCTGCATAAGGCAGTTGTTGGTTTTCTTC (SEQ ID NO: 1234) | AGGGCCAGGGACAGGAGCATTTCACATCACTAACCTAACTTGGGAAGCTG (SEQ ID NO: 1235) | GAAGAAAACCAACAACTGCCTTATGCAGGGGTGGGGACAGGGAAGGAGGT (SEQ ID NO: 1236) |
| MAST2 | NM_015112.1 | ATGCTCCTCACAGGAAAAGCTGCATCAGTTGCCTTTCCAGCCTACAGCTGATGAGCTGCACTTTTTGACGAAGCATTTCAG CACAGAGAGCGTACCAGAT (SEQ ID NO: 1237) | CAGCTGTAGGCTGGAAAGGCAACTGATGCAGCTTTTCTGTGAGGAGCAT (SEQ ID NO: 1238) | ATCTGGTACGCTCTCTGTGCTGAAATGCTTCGTCAAAAAGTGCAGCTCAT (SEQ ID NO: 1239) |
| MATR3 | NM_001194954.1 | AAGGAGTGGAGTCAACATATCAATGGAGCAAGTCACAGTCGTCGATGCCAGCTTCTTCTTGAAATCTACCCAGAATGGAATCCTGACAATGATACAGGAC (SEQ ID NO: 1240) | TGGCATCGACGACTGTGACTTGCTCCATTGATATGTTGACTCCACTC (SEQ ID NO: 1241) | GTCCTGTATCATTGTCAGGATTCCATTCTGGGTAGATTTCAAGAAGAAGC (SEQ ID NO: 1242) |
| MCL1 | NM_021960.3 | GCTGTAACTTCCTAGAGTTGCACCCTAGCAACCTAGCCAGAAAAGCAAGTGGCAAGAGGATTATGGCTAACAAGAATAAATACATGGGAAGAGTGCTCCC (SEQ ID NO: 1243) | ACTTGCTTTTCTGGCTAGGTTGCTAGGGTGCAACTCTAGGAAGTTACAGC (SEQ ID NO: 1244) | GGGAGCACTCTTCCCATGTATTTATTCTTGTTAGCCATAATCCTCTTGCC (SEQ ID NO: 1245) |
| MCM10 | NM_018518.3 | AATAACTTCTTGACGCGGGAAAATGGC | AGCTCATCAAATGCGTCGGGCTCG | CATCATCAGCCTCTTCTGTATAAG |

TABLE 1-continued

| Gene | GenBank Accession No. | Target Sequence | Capture Probe Sequence | Reporter Probe Sequence |
|---|---|---|---|---|
| | | GAGCCCGACGCATT TGATGAGCTCTTTG ATGCCGACGGCGA CGGTGAATCTTATA CAGAAGAGGCTGA TGATG (SEQ ID NO: 1246) | CCATTTTCCCGCG TCAAGAAGTTATT (SEQ ID NO: 1247) | ATTCACCGTCGC CGTCGGCATCAA AG (SEQ ID NO: 1248) |
| MCM7 | NM_182776.1 | TGGGAAATATCCCT CGTAGTATCACGGT GCTGGTAGAAGGA GAGAACACAAGGA TTGCCCAGCCTGGA GACCACGTCAGCGT CACTGGTATTTTCT TGCC (SEQ ID NO: 1249) | TGTGTTCTCTCCT TCTACCAGCACC GTGATACTACGA GGGATATT (SEQ ID NO: 1250) | CAAGAAAATACC AGTGACGCTGAC GTGGTCTCCAGG CTGGGCAATCCT (SEQ ID NO: 1251) |
| MDFIC | NM_199072.2 | CAATAGCCACTTCA CACATGGAGAGAT GCAAGACCAGTCC ATTTGGGAAATCC TTCGGATGGTGAAC TCATTAGAACCCAA CCTCAGCGCTTGCC TCAG (SEQ ID NO: 1252) | TTCCCCAAATGG ACTGGTCTTGCAT CTCTCCATGTGTG AAGTGGCTATTG (SEQ ID NO: 1253) | CTGAGGCAAGCG CTGAGGTTGGGT TCTAATGAGTTC ACCATCCGAAGG AT (SEQ ID NO: 1254) |
| MDM2 | NM_002392.2 | GATCTACAGGAACT TGGTAGTAGTCAAT CAGCAGGAATCATC GGACTCAGGTACAT CTGTGAGTGAGAAC AGGTGTCACCTTGA AGGTGGGAGTGAT CAA (SEQ ID NO: 1255) | CTGAGTCCGATG ATTCCTGCTGATT GACTACTACCAA GTTCCTGTAGATC (SEQ ID NO: 1256) | TTGATCACTCCC ACCTTCAAGGTG ACACCTGTTCTC ACTCACAGATGT AC (SEQ ID NO: 1257) |
| MFAP5 | NM_003480.2 | CTCATCTCATTGTT TCAGCGGAGGCCA AATCTGAAGTCCTT TCCAGGGAGTGGCT CTGTTCATCTTATT CGCCAGCCAAAGT AGGAACAGCGTAA GAGGA (SEQ ID NO: 1258) | CTCCCTGGAAAG GACTTCAGATTTG GCCTCCGCTGAA ACAATGAGATGA G (SEQ ID NO: 1259) | TCCTCTTACGCT GTTCCTACTTTG GCTGGCGAATAA GATGAACAGAG CCA (SEQ ID NO: 1260) |
| MFNG | NM_002405.2 | CGAACAGGACCAG ATTTTGTTTGGAGC CTCAGCATGCCGGG GCCCAGATGATGG AGCATAACGGGTCC CAGCCAATTGTGAT GATCCTTTTTGCTC ATTT (SEQ ID NO: 1261) | CATCTGGGCCCC GGCATGCTGAGG CTCCAAACAAAA TCTGGTCCT (SEQ ID NO: 1262) | AAATGAGCAAA AAGGATCATCAC AATTGGCTGGGA CCCGTTATGCTC CAT (SEQ ID NO: 1263) |
| MFSD2A | NM_001136493.1 | GTTGGGATCTCATC AGCAGTGCCATTTC TCATCTTGGTGGCC CTCATGGAGAGTAA CCTCATCATTACAT ATGCGGTAGCTGTG GCAGCTGGCATCAG TG (SEQ ID NO: 1264) | TCCATGAGGGCC ACCAAGATGAGA AATGGCACTGCT GATGAGATCCCA AC (SEQ ID NO: 1265) | CACTGATGCCAG CTGCCACAGCTA CCGCATATGTAA TGATGAGGTTAC TC (SEQ ID NO: 1266) |
| MGC87042 | NM_001164460.1 | CAGGCTATACTGAC TGGAAGCCTGGTAG CTTTGTGCAACTTT CAGGCCACTAAACT GGCCAAGACACAA CTGGTAGGCACACC AAATTTCTGGCAGG AGC (SEQ ID NO: 1267) | GTGGCCTGAAAG TTGCACAAAGCT ACCAGGCTTCCA GTCA (SEQ ID NO: 1268) | GAAATTTGGTGT GCCTACCAGTTG TGTCTTGGCCAG TTTA (SEQ ID NO: 1269) |

TABLE 1-continued

| Gene | GenBank Accession No. | Target Sequence | Capture Probe Sequence | Reporter Probe Sequence |
|---|---|---|---|---|
| MIR17HG | NR_027349.1 | TGGACCTAACTGCACCAGTAGCTTTTCTGAGAATACTTGCTGAAAAGGAAGTTTTCTGGAATGGTATTTGCTAAGTGGAAGCCAGAAGAGGAGGAAAATG (SEQ ID NO: 1270) | TTCCTTTTCAGCAAGTATTCTAGAAAAGCTACTGGTGCAGTTAGGTCCA (SEQ ID NO: 1271) | CATTTTCCTCCTCTTCTGGCTTCCATTAGCAAATACCATTCCAGAAAAC (SEQ ID NO: 1272) |
| MKI67 | NM_002417.2 | AGCAGATGTAGAGGGAGAACTCTTAGCGTGCAGGAATCTAATGCCATCAGCAGGCAAAGCCATGCACACGCCTAAACCATCAGTAGGTGAAGAGAAAGAC (SEQ ID NO: 1273) | CTGATGGCATTAGATTCCTGCACGCTAAGAGTTCTCCCTCTACATCTG (SEQ ID NO: 1274) | GTCTTTCTCTTCACCTACTGATGGTTTAGGCGTGTGCATGGCTTTGCCTG (SEQ ID NO: 1275) |
| MLL2 | NM_003482.3 | CCAACATTAATTTTCCTAATCTCAAGCAAGACTACCCAGACTGGTCAAGCCGTTGCAAACAAATCATGAAGCTCTGGAGAAAGGTTCCAGCAGCTGACAA (SEQ ID NO: 1276) | GCTTGACCAGTCTGGGTAGTCTTGCTTGAGATTAGGAAAATTAATGTTGG (SEQ ID NO: 1277) | CAGCTGCTGGAACCTTTCTCCAGAGCTTCATGATTTGTTTGCAACG (SEQ ID NO: 1278) |
| MLLT10 | NM_004641.2 | CTGAGCGGCAAAGCCCGAATGGTCTCTAGCGACCGGCCCGTGTCACTGGAGGACGAGGTCTCCCATAGTATGAAGGAGATGATTGGAGGCTGTTGCGTTT (SEQ ID NO: 1279) | TCCAGTGACACGGGCCGGTCGCTAGAGACCATTCG (SEQ ID NO: 1280) | AAACGCAACAGCCTCCAATCATCTCCTTCATACTATGGGAGACCTCGTCC (SEQ ID NO: 1281) |
| MME | NM_000902.2 | GGATTGTAGGTGCAAGCTGTCCAGAGAAAAGAGTCCTTGTTCCAGCCCTATTCTGCCACTCCTGACAGGGTGACCTTGGGTATTTGCAATATTCCTTTGG (SEQ ID NO: 1282) | TAGGGCTGGAACAAGGACTCTTTTCTCTGGACAGCTTGCACCTACAATCC (SEQ ID NO: 1283) | CCAAAGGAATATTGCAAATACCCAAGGTCACCCTGTCAGGAGTGGCAGAA (SEQ ID NO: 1284) |
| MMP1 | NM_002421.2 | CAACTTACATCGTGTTGCGGCTCATGAACTCGGCCATTCTCTTGGACTCTCCCATTCTACTGATATCGGGGCTTTGATGTACCCTAGCTACACCTTCAGT (SEQ ID NO: 1285) | AGAGTCCAAGAGAATGGCCGAGTTCATGAGCCGCAACACGATGTAAGTTG (SEQ ID NO: 1286) | ACTGAAGGTGTAGCTAGGGTACATCAAAGCCCCGATATCAGTAGAATGGG (SEQ ID NO: 1287) |
| MMP2 | NM_004530.2 | CCCGGAGGGGCCTGGCAGCCGTGCCTTCAGCTCTACAGCTAATCAGCATTCTCACTCCTACCTGGTAATTTAAGATTCCAGAGAGTGGCTCCTCCCGGTG (SEQ ID NO: 1288) | AATGCTGATTAGCTGTAGAGCTGAAGGCACGGCTGCCAGG (SEQ ID NO: 1289) | CACCGGGAGGAGCCACTCTCTGGAATCTTAAATTACCAGGTAGGAGTGAG (SEQ ID NO: 1290) |
| MMP9 | NM_004994.2 | CACTACTGTGCCTTTGAGTCCGGTGGAC | AGATGTTCACGTTGCAGGCATCGTC | CCCATCCTTGAACAAATACAGCTG |

TABLE 1-continued

| Gene | GenBank Accession No. | Target Sequence | Capture Probe Sequence | Reporter Probe Sequence |
|---|---|---|---|---|
| | | GATGCCTGCAACGT GAACATCTTCGACG CCATCGCGGAGATT GGGAACCAGCTGT ATTTGTTCAAGGAT GGG (SEQ ID NO: 1291) | CACCGGACTCAA AGGCACAG (SEQ ID NO: 1292) | GTTCCCAATCTC CGCGATGGCGTC GA (SEQ ID NO: 1293) |
| MMRN2 | NM_024756.2 | GCCAAGGATGGGC TGGAGGTCATTCAG TTGGTCTGTCTCTT CCCTGGAAACCTTC TGCAAAGATGGTGT GGTGTACGTGGCTT CCCTGTAACCACAT GGG (SEQ ID NO: 1294) | TTTCCAGGGAAG AGACAGACCAAC TGAATGACCTCC AGCCCATCC (SEQ ID NO: 1295) | CATGTGGTTACA GGGAAGCCACGT ACACCACACCAT CTTTGCAGAAGG (SEQ ID NO: 1296) |
| MNDA | NM_002432.1 | CCAACGGCAGGTG GATGCAAGAAGAA ATGTTCCCCAAAAC GACCCAGTGACAGT GGTGGTACTGAAA GCAACAGCGCCATT TAAATACGAGTCCC CAGAA (SEQ ID NO: 1297) | TCACTGGGTCGTT TTGGGGAACATTT CTTCTTGCATCCA CCTGCCGTTGG (SEQ ID NO: 1298) | TTCTGGGGACTC GTATTTAAATGG CGCTGTTGCTTT CAGTACCACCAC TG (SEQ ID NO: 1299) |
| MOBKL2C | NM_145279.4 | TTCTCTTACCCAGA GATGCCCATGAGCT GACATTTTACTCAT CCCTCTGCCTCCAA GAAGGCCTGTATTA TACGTGTCCTCCTG GGGGTTGGAGATG ATC (SEQ ID NO: 1300) | GCAGAGGGATGA GTAAAATGTCAG CTCATGGGCATCT CTGGGTAAGAGA A (SEQ ID NO: 1301) | TCTCCAACCCCC AGGAGGACACG TATAATACAGGC CTTCTTGGAG (SEQ ID NO: 1302) |
| MPEG1 | XM_937323.1 | GCTGTGAAGCGCTA TTATACATTCAACA CCTACCCTGGCTGC ACAGATCTCAATTC TCCCAACTTCAATT TTCAGGCCAACACG GATGATGGCTCCTG CG (SEQ ID NO: 1303) | AGATCTGTGCAG CCAGGGTAGGTG TTGAATGTATAAT AGCGCTTCA (SEQ ID NO: 1304) | CGCAGGAGCCAT CATCCGTGTTGG CCTGAAAATTGA AGTTGGGAGAAT TG (SEQ ID NO: 1305) |
| MS4A1 | NM_152866.2 | CTTCTGATGATCCC AGCAGGGATCTATG CACCCATCTGTGTG ACTGTGTGGTACCC TCTCTGGGGAGGCA TTATGTATATTATTT CCGGATCACTCCTG G (SEQ ID NO: 1306) | CACACAGTCACA CAGATGGGTGCA TAGATCCCTGC (SEQ ID NO: 1307) | CCAGGAGTGATC CGGAAATAATAT ACATAATGCCTC CCCAGAGAGGGT AC (SEQ ID NO: 1308) |
| MST1R | NM_002447.1 | CCACTTTGGAGTTG TCTACCACGGAGAA TACATAGACCAGGC CCAGAATCGAATCC AATGTGCCATCAAG TCACTAAGTCGCAT CACAGAGATGCAG CAG (SEQ ID NO: 1309) | GATTCTGGGCCTG GTCTATGTATTCT CCGTGGTAGACA ACTCCAAAGTG (SEQ ID NO: 1310) | CTGCTGCATCTC TGTGATGCGACT TAGTGACTTGAT GGCACATTGGAT TC (SEQ ID NO: 1311) |
| MSX2 | NM_002449.4 | GCCGCTGCCGGGTT GCCAGCGGAGTCG CGCGTCGGGAGCTA CGTAGGGCAGAGA AGTCATGGCTTCTC CGTCCAAAGGCAAT GACTTGTTTTCGCC CGAC (SEQ ID NO: 1312) | TGCCCTACGTAGC TCCCGACGCGCG ACTCCGCTGGCA ACCCG (SEQ ID NO: 1313) | GTCGGGCGAAA ACAAGTCATTGC CTTTGGACGGAG AAGCCATGACTT CTC (SEQ ID NO: 1314) |

TABLE 1-continued

| Gene | GenBank Accession No. | Target Sequence | Capture Probe Sequence | Reporter Probe Sequence |
|---|---|---|---|---|
| MTHFD2 | NM_006636.3 | TGGAGGTGTTGGCCCCATGACAGTGGCAATGCTAATGAAGAATACCATTATTGCTGCAAAAAGGTGCTGAGGCTTGAAGAGCGAGAAGTGCTGAAGTCT (SEQ ID NO: 1315) | TAATGGTATTCTTCATTAGCATTGCCACTGTCATGGGGCCAACACCTCCA (SEQ ID NO: 1316) | AGACTTCAGCACTTCTCGCTCTTCAAGCCTCAGCACCTTTTTTGCAGCAA (SEQ ID NO: 1317) |
| MTUS2 | NM_001033602.2 | AACCTGCAAACACAAATTCAGTTACAGCTTAGCTGTCCGAATTAGGAACCGCTTACATAGCCGCACCTGCTAAATGCAGTTACACAGCAATACTGACTTC (SEQ ID NO: 1318) | GGTTCCTAATTCGGACAGCTAAGCTGTAACTGAATTTGTGTTTGCAGGTT (SEQ ID NO: 1319) | GAAGTCAGTATTGCTGTGTAACTGCATTTAGCAGGTGCGGCTATGTAAGC (SEQ ID NO: 1320) |
| MUC16 | NM_024690.2 | TCTTCTAGACACAGGTTTTCCCAGGTCAAATGCGGGGACCCCAGCCATATCTCCCACCCTGAGAAATTTTGGAGTTTCAGGGAGCTCAGAAGCTCTGCAG (SEQ ID NO: 1321) | ATATGGCTGGGGTCCCCGCATTTGACCTGGGAAAACCTGTGTCTAGAAGA (SEQ ID NO: 1322) | CTGCAGAGCTTCTGAGCTCCCTGAAACTCCAAAATTTCTCAGGGTGGGAG (SEQ ID NO: 1323) |
| MYB | NM_005375.2 | AACTGTTGCATGGATCCTGTGTTTGCAACTGGGGAGACAGAAACTGTGGTTGATAGCCAGTCACTGCCTTAAGAACATTTGATGCAAGATGGCCAGCACT (SEQ ID NO: 1324) | ACCACAGTTTCTGTCTCCCAGTTGCAAACACAGGATCCATGCAACAGTT (SEQ ID NO: 1325) | AGTGCTGGCCATCTTGCATCAAATGTTCTTAAGGCAGTGACTGGCTATCA (SEQ ID NO: 1326) |
| MYBL1 | XM_034274.14 | GGCAAACGCTGTGTTATCCTCTTTGCAGACCATCCCAGAATTTGCAGAGACTCTAGAACTTATTGAATCTGATCCTGTAGCATGGAGTGACGTTACCAGT (SEQ ID NO: 1327) | TCTCTGCAAATTCTGGGATGGTCTGCAAAGAGGATAACACAGCGTTTGCC (SEQ ID NO: 1328) | ACTGGTAACGTCACTCCATGCTACAGGATCAGATTCAATAAGTTCTAGAG (SEQ ID NO: 1329) |
| MYC | NM_002467.3 | TCGGACACCGAGGAGAATGTCAAGAGGCGAACACACAACGTCTTGGAGCGCCAGAGGAGGAACGAGCTAAAACGGAGCTTTTTTGCCCTGCGTGACCAGA (SEQ ID NO: 1330) | CGCTCCAAGACGTTGTGTGTTCGCCTCTTGACATTCTCCTCGGTG (SEQ ID NO: 1331) | TCTGGTCACGCAGGGCAAAAAGCTCCGTTTTAGCTCGTTCCTCCTCTGG (SEQ ID NO: 1332) |
| MYD88 | NM_002468.3 | ACGTTTTTCTAGGTACAGCTCCCAGGAACAGCTAGGTGGGAAAGTCCCATCACTGAGGGAGCCTAACCATGTCCCTGAACAAAAATTGGGCACTCATCTA (SEQ ID NO: 1333) | ATGGGACTTTCCCACCTAGCTGTTCCTGGGAGCTGTACCTAGAAAACGT (SEQ ID NO: 1334) | TAGATGAGTGCCCAATTTTTGTTCAGGGACATGGTTAGGCTCCCTCAGTG (SEQ ID NO: 1335) |
| MYO7A | NM_001127180.1 | CGACGCCTTCGTAAAGGGGATCTACGG | CCACAATCCACACGAACAGCCGCC | TCACATCCTGGGAGGGAGGCTTGT |

TABLE 1-continued

| Gene | GenBank Accession No. | Target Sequence | Capture Probe Sequence | Reporter Probe Sequence |
|---|---|---|---|---|
| | | GCGGCTGTTCGTGT GGATTGTGGACAA GATCAACGCAGCA ATTTACAAGCCTCC CTCCCAGGATGTGA AGAAC (SEQ ID NO: 1336) | CGTAGATCCCCTT TACGAAGG (SEQ ID NO: 1337) | AAATTGCTGCGT TGATCTTGT (SEQ ID NO: 1338) |
| MZT2B | NM_025029.3 | TTGAAAGAGGCATT TACCGAGCGCCCAA TGTATGCCTGGCAC TGGGCTGGGTGCTG CCACCTAAGCGAGC ACGACCAATGCAGT CTATCAGGGAGGCC CA (SEQ ID NO: 1339) | CCAGCCCAGTGC CAGGCATACATT GGGCGCTCGGTA AATG (SEQ ID NO: 1340) | TGATAGACTGCA TTGGTCGTGCTC GCTTAGGTGGCA GCAC (SEQ ID NO: 1341) |
| NAIF1 | NM_197956.3 | GATTGGCCTTGGCC TTAGACCGGCCACG TGCACAGCTCCCTC TTTAATAAACGCTT AGGGGTTGCACTGT TTTTGAGAAGAGGA ATTTGTTGGGCTCC TG (SEQ ID NO: 1342) | TTATTAAAGAGG GAGCTGTGCACG TGGCCGGTCTAA GGCCAAGG (SEQ ID NO: 1343) | CAGGAGCCCAAC AAATTCCTCTTC TCAAAAACAGTG CAACCCCTAAGC GT (SEQ ID NO: 1344) |
| NANS | NM_018946.3 | TTCCTTATCTGGAA AAGACAGCCAAAA AAGGTCGCCCAATG GTGATCTCCAGTGG GATGCAGTCAATGG ACACCATGAAGCA AGTTTATCAGATCG TGAA (SEQ ID NO: 1345) | GGAGATCACCAT TGGGCGACCTTTT TTGGCTGTCTTTT CCAGATAAGGAA (SEQ ID NO: 1346) | TTCACGATCTGA TAAACTTGCTTC ATGGTGTCCATT GACTGCATCCCA CT (SEQ ID NO: 1347) |
| NASP | NM_172164.1 | TTTGGCTGTGAGCC AGGCCTAGGATGGT TCTTGTCCTATATC CACCTAGTCTTCAC CTGGGGCTATAATT CTGTCCTGGAAAAA GAACTCTGAAAACC TG (SEQ ID NO: 1348) | ACTAGGTGGATA TAGGACAAGAAC CATCCTAGGCCTG GCTCACAGCCAA A (SEQ ID NO: 1349) | CAGGTTTTCAGA GTTCTTTTCCA GGACAGAATTAT AGCCCCAGGTGA AG (SEQ ID NO: 1350) |
| NBN | NM_002485.4 | GACTACAAAGAATT ACTGTGATCCTCAG GGCCATCCCAGTAC AGGATTAAAGACA ACAACTCCAGGACC AAGCCTTTCACAAG GCGTGTCAGTTGAT GAA (SEQ ID NO: 1351) | TTAATCCTGTACT GGGATGGCCCTG AGGATCACAGTA ATTCTTTGTAGTC (SEQ ID NO: 1352) | TTCATCAACTGA CACGCCTTGTGA AAGGCTTGGTCC TGGAGTTGTTGT CT (SEQ ID NO: 1353) |
| NCAPG | NM_022346.3 | GTATTGCACCATCA GCAAAGACTTTGCC AAAAATTGTAGGG CGCACCAAGGATGT GAAAGAGGCTGTC AGAAAGCTGGCTTA TCAGGTTTTAGCTG AAAA (SEQ ID NO: 1354) | CTTGGTGCGCCCT ACAATTTTTGGCA AAGTCTTTGCTGA TGGTGCAATAC (SEQ ID NO: 1355) | TTTTCAGCTAAA ACCTGATAAGCC AGCTTTCTGACA GCCTCTTTCACA TC (SEQ ID NO: 1356) |
| NCAPH | NM_015341.3 | TGCTACTATTCTGA CCAAGTCCACTTTG GAGAACCAGAATT GGAGAGCTACCAC CCTTCCTACAGATT TCAACTACAATGTT GACACTCTGGTCCA GCTT (SEQ ID NO: 1357) | TAGCTCTCCAATT CTGGTTCTCCAAA GTGGACTTGGTC AGAATAGTAGCA (SEQ ID NO: 1358) | AAGCTGGACCAG AGTGTCAACATT GTAGTTGAAATC TGTAGGAAGGGT GG (SEQ ID NO: 1359) |

TABLE 1-continued

| Gene | GenBank Accession No. | Target Sequence | Capture Probe Sequence | Reporter Probe Sequence |
|---|---|---|---|---|
| NCF2 | NM_000433.2 | GCCACTAAGGCAGCCCTGCTAGGGGAGACGCTCCAACCTGTCTTCTCTCTGTCTCCTGGCAGCTCTCTTGGCCTCCTAGTTTCTACCTAATCATGTCCCT (SEQ ID NO: 1360) | AGAGAGAAGACAGGTTGGAGCGTCTCCCCTAGCAG (SEQ ID NO: 1361) | AGGGACATGATTAGGTAGAAACTAGGAGGCCAAGAGAGCTGCCAGGAGAC (SEQ ID NO: 1362) |
| NCRNA00158 | NR_024027.2 | AGTAGGATCCAGAGCCATTTTGGAACTTTACCAAGGATTAAGGATGAGCACAGATCACATCAAGAGTCTAAATATCACTTTGGAGGCCATGTGCAGATCA (SEQ ID NO: 1363) | TGCTCATCCTTAATCCTTGGTAAAGTTCCAAAATGGCTCTGGATCCTACT (SEQ ID NO: 1364) | TGATCTGCACATGGCCTCCAAAGTGATATTTAGACTCTTGATGTGATCTG (SEQ ID NO: 1365) |
| NDST4 | NM_022569.1 | GGCTCCATCTGACTTAAAAACTTTGCAGAGAAGATGCCTAGTACCTGGATGGTATGCAGTCCACATAGAAAGATGGCTAACTTACTTTGCTACTTCTCAG (SEQ ID NO: 1366) | ATCCAGGTACTAGGCATCTTCTCTGCAAAGTTTTTAAGTCAGATGGAGC (SEQ ID NO: 1367) | CTGAGAAGTAGCAAAGTAAGTTAGCCATCTTTCTATGTGGACTGCATACC (SEQ ID NO: 1368) |
| NEBL | NM_006393.1 | GGGGTGGCATTCACTTAGGGTCTGACTTCACAGCTATGACAAAACCGAAAAAGCAAAACTGCGAGGAAGTGCTAAGATGTACGGGTCTTGGGGATATCTG (SEQ ID NO: 1369) | TTTCGGTTTTGTCATAGCTGTGAAGTCAGACCCTAAGTGAATGCCACCC (SEQ ID NO: 1370) | CAGATATCCCCAAGACCCGTACATCTTAGCACTTCCTCGCAGTTTTGCTT (SEQ ID NO: 1371) |
| NECAP2 | NM_018090.4 | CTCTCCTCTCCTCCTTGTCTGGCTCTGTTGACAAACCGGGCATGTTTGGCAGTAAATTGGCACCGTGTCACACTGTTTCCTGGGATTCAAGTATGCAACC (SEQ ID NO: 1372) | GCCAAACATGCCCGGTTTGTCAACAGAGCCAGACAAGGAGGAGAGGAG (SEQ ID NO: 1373) | GGTTGCATACTTGAATCCCAGGAAACAGTGTGACACGGTGCCAATTTACT (SEQ ID NO: 1374) |
| NEIL1 | NM_024608.2 | TTAGCAGGAGGCTCTCCTTGCTTGCACTCACCCTTTCTTATTGTCTTGCCCTGCATCTGGGGGTCTGAATTTTTGGGAGCAGGCAATATCTGAAGGTGCA (SEQ ID NO: 1375) | GGCAAGACAATAAGAAAGGGTGAGTGCAAGCAAGGAGAGCCTCCTGCTAA (SEQ ID NO: 1376) | TGCACCTTCAGATATTGCCTGCTCCCAAAAATTCAGACCCCCAGATGCAG (SEQ ID NO: 1377) |
| NEK6 | NM_014397.3 | GCATCGGGAAGCAGGAGCATCTTCTTGGCAGCCAGGCTGGGCCATCTTCTCCTGGACACCTGCTGTGTACCAGGAACTTCGTCACCTCCTTGAATGCTGG (SEQ ID NO: 1378) | AGAAGATGGCCCAGCCTGGCTGCCAAGAAGATGCT (SEQ ID NO: 1379) | ATTCAAGGAGGTGACGAAGTTCCTGGTACACAGCAGGTGTCCAGG (SEQ ID NO: 1380) |
| NEU3 | NM_006656.5 | TGGTTCTAAGATTTCTCATCTTCTCATC | CAGGCACTATGCTTGTCCTAGGGAT | TTGACATCAGAGTCCTTTATGCAG |

TABLE 1-continued

| Gene | GenBank Accession No. | Target Sequence | Capture Probe Sequence | Reporter Probe Sequence |
|---|---|---|---|---|
| | | CCTAGGACAAGCAT AGTGCCTGCATGCT TCATGATCAGTAAG TCCTGGCTGCATAA AGGACTCTGATGTC AA (SEQ ID NO: 1381) | GAGAAGATGAGA AATCTTAGAACC A (SEQ ID NO: 1382) | CCAGGACTTACT GATCATGAAGCA TG (SEQ ID NO: 1383) |
| NFATC1 | NM_172390.1 | CCAGTACCAGCGTT TCACCTACCTTCCC GCCAACGGTAACG CCATCTTTCTAACC GTAAGCCGTGAAC ATGAGCGCGTGGG GTGCTTTTTCTAAA GACGC (SEQ ID NO: 1384) | GAAAGATGGCGT TACCGTTGGCGG GAAGGTAGGTGA AACGCTGGTACT GG (SEQ ID NO: 1385) | GCGTCTTTAGAA AAAGCACCCCAC GCGCTCATGTTC ACGGCTTACGGT TA (SEQ ID NO: 1386) |
| NFIL3 | NM_005384.2 | CCTTTCTTTCTCCTC GCCGGCCCGAGAG CAGGAACACGATA ACGAAGGAGGCCC AACTTCATTCAATA AGGAGCCTGACGG ATTTATCCCAGACG GTAGA (SEQ ID NO: 1387) | CTCCTTCGTTATC GTGTTCCTGCTCT CGGGCCGGCGAG GAGAAAGAAAGG (SEQ ID NO: 1388) | TCTACCGTCTGG GATAAATCCGTC AGGCTCCTTATT GAATGAAGTTGG GC (SEQ ID NO: 1389) |
| NFKBIA | NM_020529.1 | GGATGAGGAGAGC TATGACACAGAGTC AGAGTTCACGGAGT TCACAGAGGACGA GCTGCCCTATGATG ACTGTGTGTTTGGA GGCCAGCGTCTGAC GTTA (SEQ ID NO: 1390) | CCTCTGTGAACTC CGTGAACTCTGA CTCTGTGTCATAG C (SEQ ID NO: 1391) | GCCTCCAAACAC ACAGTCATCATA GGGCAGCTCGT (SEQ ID NO: 1392) |
| NFKBIZ | NM_001005474.1 | ATTTGGTTCCCGAT GGCCCTGTGGGAG AACAGATCCGACGT ATCCTGAAGGGAA AGTCCATTCAGCAG AGAGCTCCACCGTA TTAGCTCCATTAGC TTGG (SEQ ID NO: 1393) | CTTCAGGATACGT CGGATCTGTTCTC CCACAGGGCCAT CGGGAACCAAAT (SEQ ID NO: 1394) | CCAAGCTAATGG AGCTAATACGGT GGAGCTCTCTGC TGAATGGACTTT CC (SEQ ID NO: 1395) |
| NHLH2 | NM_005599.3 | CTCTGGCTCTCCCA CCCTCTTCCCGTCT TTCTCTGCTTCCTTG TCACTGTTACTCCA GGAGACGTTCACTT TTCACCAACCTTTC TCCAAGCATCTCCA A (SEQ ID NO: 1396) | ACAGTGACAAGG AAGCAGAGAAAG ACGGGAAGAGGG TGGGAGAGCCAG AG (SEQ ID NO: 1397) | TtGGAGATGCTT GGAGAAAGGTT GGTGAAAAGTG AACGTCTCCTGG AGTA (SEQ ID NO: 1398) |
| NIPA2 | NM_001008860.1 | AACGATTTCTCAGG TTGAGATGATCACC GTGAATCCGGCTTC CTCTGAGCATTCGA TGGCCTTAGCACCT CATCAAGCCAGCAC ATCCTGCCTGCTGT TG (SEQ ID NO: 1399) | GCTCAGAGGAAG CCGGATTCACGG TGATCATCTCAAC CTGAGAAATCGT T (SEQ ID NO: 1400) | GCAGGATGTGCT GGCTTGATGAGG TGCTAAGGCCAT CGAAT (SEQ ID NO: 1401) |
| NOC3L | NM_022451.9 | GTTGAGATTGTACT CCAGTGCCTTGATG TCATGCTAACTAAG CGCAGAAAGCAAG TTTCTCAGCAGCGA GCTCTTGCCTTCAT CAAACGCCTTTGTA CCC (SEQ ID NO: 1402) | TTTCTGCGCTTAG TTAGCATGACATC AAGGCACTGGAG TACAATCTCAAC (SEQ ID NO: 1403) | GGGTACAAAGG CGTTTGATGAAG GCAAGAGCTCGC TGCTGAGAAACT TGC (SEQ ID NO: 1404) |

TABLE 1-continued

| Gene | GenBank Accession No. | Target Sequence | Capture Probe Sequence | Reporter Probe Sequence |
|---|---|---|---|---|
| NOP14 | NM_003703.1 | CTGATCCACAAACACAAGCGTGAATTTAAAGGGGCCGTTCGAGAAATCCGCAAGGACAATCAGTTCCTGGCGAGGATGCAACTCTCAGAAATCATGGAAC (SEQ ID NO: 1405) | CGGATTTCTCGAACGGCCCCTTTAAATTCACGCTTGTGTTTGTGGATCAG (SEQ ID NO: 1406) | TTCCATGATTTCTGAGAGTTGCATCCTCGCCAGGAACTGATTGTCCTTG (SEQ ID NO: 1407) |
| NOP56 | NM_006392.2 | TTCTCTATGCGTGTCAGGGAGTGGTACGGGTATCACTTTCCGGAGCTGGTGAAGATCATCAACGACAATGCCACATACTGCCGTCTTGCCCAGTTTATTG (SEQ ID NO: 1408) | ACCAGCTCCGGAAAGTGATACCCGTACCACTCCCTGACACGCATAGAGAA (SEQ ID NO: 1409) | CAATAAACTGGGCAAGACGGCAGATGTGGCATTGTCGTTGATGATCTTC (SEQ ID NO: 1410) |
| NOTCH1 | NM_017617.3 | CTGCCAGGCTTCACCGGCCAGAACTGTGAGGAAAATATCGACGATTGTCCAGGAAACAACTGCAAGAACGGGGGTGCCTGTGTGGACGGCGTGAACACCT (SEQ ID NO: 1411) | GGACAATCGTCGATATTTTCCTCACAGTTCTGGCCGGTGAAGCCTGGCAG (SEQ ID NO: 1412) | TCCACACAGGCACCCCGTTCTTGCAGTTGTTTCCT (SEQ ID NO: 1413) |
| NOTCH2 | NM_024408.2 | TCCTGGTGAACAAGAACAGGAGGTGGCTGGCTCTAAAGTCTTTCTGGAAATTGACAACCGCCAGTGTGTTCAAGACTCAGACCACTGCTTCAAGAACACG (SEQ ID NO: 1414) | TTTCCAGAAAGACTTTAGAGCCAGCCACCTCCTGTTCTTGTTCACCAGGA (SEQ ID NO: 1415) | CGTGTTCTTGAAGCAGTGGTCTGAGTCTTGAACACACTGGCGGTTGTCAA (SEQ ID NO: 1416) |
| NRG1 | NM_004495.2 | TACATCTACATCCACCACTGGGACAAGCCATCTTGTAAAATGTGCGAGAAGGAGAAAACTTTCTGTGTGAATGGAGGGAGTGCTTCATGGTGAAAGAC (SEQ ID NO: 1417) | TCTCCGCACATTTTACAAGATGGCTTGTCCCAGTGGTGGATGTAGATGTA (SEQ ID NO: 1418) | GTCTTTCACCATGAAGCACTCCCCTCCATTCACACAGAAAGTTTTCTCT (SEQ ID NO: 1419) |
| NUF2 | NM_145697.2 | GACTTCCAGTAGGAGGCGGCAAGTTTGAAAAGTGATGACGGTTGACGTTTGCTGATTTTTGACTTTGCTTGTAGCTGCTCCCCGAACTCGCCGTCTTCCT (SEQ ID NO: 1420) | AAACGTCAACCGTCATCACTTTTCAAACTTGCCGCCTCCTACTGGAAGTC (SEQ ID NO: 1421) | AGGAAGACGGCGAGTTCGGGGAGCAGCTACAAGCAAAGTCAAAAATCAGC (SEQ ID NO: 1422) |
| NUP62 | NM_016553.3 | GGCACTGCAAAGACGGCAACAACCACACCTGCTACAGGGTTTTCTTTCTCCACCTCTGGCACTGGAGGGTTTAATTTTGGGGCTCCCTTCCAACCAGCCA (SEQ ID NO: 1423) | GAGAAAGAAAACCCTGTAGCAGGTGTGGTTGTTGCCGTCTTTGCAGTGCC (SEQ ID NO: 1424) | CTGGTTGGAAGGGAGCCCCAAAATTAAACCCTCCAGTGCCAGAGGTG (SEQ ID NO: 1425) |
| NUSAP1 | NM_018454.6 | TCAAGCGCTCTGCTATCTCTGCAGCTAA | AGCTGAAAACCTGACACCCGTTTTA | CTGGCTGGAGTCTTGGTCAGTGAA |

TABLE 1-continued

| Gene | GenBank Accession No. | Target Sequence | Capture Probe Sequence | Reporter Probe Sequence |
|------|----------------------|-----------------|------------------------|-------------------------|
| | | AACGGGTGTCAGGT TTTCAGCTGCTACT AAAGATAATGAGC ATAAGCGTTCACTG ACCAAGACTCCAGC CAG (SEQ ID NO: 1426) | GCTGCAGAGATA GCAGAGCGCTTG A (SEQ ID NO: 1427) | CGCTTATGCTCA TTATCTTTAGTA GC (SEQ ID NO: 1428) |
| OAS2 | NM_016817.2 | AAGCAAAGGAATG GTTATCCTCTCCCT GCTTCAAGGATGGG ACTGGAAACCCAAT ACCACCTTGGAAAG TGCCGACAATGCAG ACACCAGGAAGTT GTGG (SEQ ID NO: 1429) | GTTTCCAGTCCCA TCCTTGAAGCAG GGAGAGGATAAC CATTCCTTTGCTT (SEQ ID NO: 1430) | CCACAACTTCCT GGTGTCTGCATT GTCGGCACTTTC CAAGGTGGTATT GG (SEQ ID NO: 1431) |
| OAS3 | NM_006187.2 | GAGTGCCTTAGACA GCCTGACTCTCCAC AAACCACTGTTAAA ACTTACCTGCTAGG AATGCTAGATTGAA TGGGATGGGAAGA GCCTTCCCTCATTA TTG (SEQ ID NO: 1432) | AGGTAAGTTTTA ACAGTGGTTTGTG GAGAGTCAGGCT GTCTAAGGCACT C (SEQ ID NO: 1433) | CAATAATGAGGG AAGGCTCTTCCC ATCCCATTCAAT CTAGCATTCCTA GC (SEQ ID NO: 1434) |
| OPA1 | NM_130837.1 | CTGAGACCATATCC TTAAATGTAAAAGG CCCTGGACTACAGA GGATGGTGCTTGTT GACTTACCAGGTGT GATTAATACTGTGA CATCAGGCATGGCT CC (SEQ ID NO: 1435) | CACCATCCTCTGT AGTCCAGGGCCT TTTACATTTAAGG ATATGGTCTCAG (SEQ ID NO: 1436) | GGAGCCATGCCT GATGTCACAGTA TTAATCACACCT GGTAAGTCAACA AG (SEQ ID NO: 1437) |
| OPN3 | NM_014322.2 | ACTCACCTCCTCCT GGTCAACATCAGCC TCAGCGACCTGCTG GTGTCCCTCTTCGG GGTCACCTTTACCT TCGTGTCCTGCCTG AGGAACGGCTGGG TGT (SEQ ID NO: 1438) | AGGGACACCAGC AGGTCGCTGAGG CTGATGTTGAC (SEQ ID NO: 1439) | CAGCCGTTCCTC AGGCAGGACAC GAAGGTAAAGG TGACCCCGAAG (SEQ ID NO: 1440) |
| OSBPL3 | NM_145320.1 | AGAGGATTGAACA ACTGCAGAGAGAA AGGCGGCGGGTCTT AGAAGAAAATCAT GTGGAGCACCAGC CTCGGTTTTTCAGG AAATCCGACGATG ACTCTTG (SEQ ID NO: 1441) | ATTTTCTTCTAAG ACCCGCCGCCTTT CTCTCTGCAGTTG TTCAATCCTCT (SEQ ID NO: 1442) | CAAGAGTCATCG TCGGATTTCCTG AAAAACCGAGG CTGGTGCTCCAC ATG (SEQ ID NO: 1443) |
| PA2G4 | NM_006191.2 | TGGATTGCTGGGGG TTTGTAGAGAAAGG TGACAAATTTCAGT ACCTCTGGCATGCT GTCCCAGGAAACTA GGGCTCCCACTAAC TTATGAGGTTTTTA AA (SEQ ID NO: 1444) | CCAGAGGTACTG AAATTTGTCACCT TTCTCTACAAACC CCCAGCAATCCA (SEQ ID NO: 1445) | TTTAAAAACCTC ATAAGTTAGTGG GAGCCCTAGTTT CCTGGGACAGCA TG (SEQ ID NO: 1446) |
| PAG1 | NM_018440.3 | TCACATGATGGGT TCTTTAGTACATGG TAACAGCCATGTCA TCTTACACACCTAG CATTGTGAATGCTG TAGTGACATCCTTT ATAGGCACCTTACA GC (SEQ ID NO: 1447) | GTGTAAGATGAC ATGGCTGTTACCA TGTACTAAAGAA CCCCATCATGTGA (SEQ ID NO: 1448) | GCTGTAAGGTGC CTATAAAGGATG TCACTACAGCAT TCACAATGCTAG GT (SEQ ID NO: 1449) |

TABLE 1-continued

| Gene | GenBank Accession No. | Target Sequence | Capture Probe Sequence | Reporter Probe Sequence |
|---|---|---|---|---|
| PARM1 | NM_015393.3 | GACCATGCCTGGTGCCACAGCCATGGTTTCCATTTCTAGATGAAAGGATGGCCTAGGACATAGGTCTCAAAGACTCTTGGATCAGAATCAGGAGATTAGG (SEQ ID NO: 1450) | CATCCTTTCATCTAGAAATGGAAACCATGGCTGTGGCACCAGGCATGGTC (SEQ ID NO: 1451) | TAATCTCCTGATTCTGATCCAAGAGTCTTTGAGACCTATGTCCTAGGC (SEQ ID NO: 1452) |
| PAX6 | NM_001604.4 | CTTTAACTAGGGGCGCGCAGATGTGTGAGGCCTTTTATTGTGAGAGTGGACAGACATCCGAGATTTCAGAGCCCCATATTCGAGCCCCGTGGAATCCCGC (SEQ ID NO: 1453) | TCCACTCTCACAATAAAAGGCCTCACACATCTGCGCGCCCCTAGTTAAAG (SEQ ID NO: 1454) | GGATTCCACGGGGCTCGAATATGGGGCTCTGAAATCTCGGATGTCTG (SEQ ID NO: 1455) |
| PCNA | NM_002592.2 | GGTGTTGGAGGCACTCAAGGACCTCATCAACGAGGCCTGCTGGGATATTAGCTCCAGCGGTGTAAACCTGCAGAGCATGGACTCGTCCCACGTCTCTTTG (SEQ ID NO: 1456) | TAATATCCCAGCAGGCCTCGTTGATGAGGTCCTTGAGTG (SEQ ID NO: 1457) | CGAGTCCATGCTCTGCAGGTTTACACCGCTGGAGC (SEQ ID NO: 1458) |
| PDCD1LG2 | NM_025239.3 | TGTGGAGCTGTGGCAAGTCCTCATATCAAATACAGAACATGATCTTCCTCCTGCTAATGTTGAGCCTGGAATTGCAGCTTCACCAGATAGCAGCTTTATT (SEQ ID NO: 1459) | GAGGAAGATCATGTTCTGTATTTGATATGAGGACTTGCCACAGCTCCACA (SEQ ID NO: 1460) | AATAAAGCTGCTATCTGGTGAAGCTGCAATTCCAGGCTCAACATTAGCAG (SEQ ID NO: 1461) |
| PDE4DIP | NM_001002810.2 | AGGAGAACTTCAGCCTCAAGCTGCGCATCTACTTCCTGGAGGAGCGCATGCAACAGAAGTATGAGGCCAGCCGGGAGGACATCTACAAGCGGAACATTGA (SEQ ID NO: 1462) | CATGCGCTCCTCCAGGAAGTAGATGCGCAGCTTGAG (SEQ ID NO: 1463) | TAGATGTCCTCCCGGCTGGCCTCATACTTCTGTTG (SEQ ID NO: 1464) |
| PDE9A | NM_001001567.1 | CAGCAGGACCAACTGCCCCTGTAAGTACAGTTTTTTGGATAACCACAAGAAGTTGACTCCTCGACGCGATGTTCCCACTTACCCCAAGTACCTGCTCTCT (SEQ ID NO: 1465) | TCTTGTGGTTATCCAAAAAACTGTACTTACAGGGGCAGTTGGTCCTGCTG (SEQ ID NO: 1466) | GCAGGTACTTGGGGTAAGTGGGAACATCGCGTCGAGGAGTCAACT (SEQ ID NO: 1467) |
| PDGFRA | NM_006206.3 | TAGTGCTTGGTCGGGTCTTGGGGTCTGGAGCGTTTGGGAAGGTGGTTGAAGGAACAGCCTATGGATTAAGCCGGTCCCAACCTGTCATGAAAGTTGCAGT (SEQ ID NO: 1468) | TTCAACCACCTTCCCAAACGCTCCAGACCCCAAGACCCGACCAAGCACTA (SEQ ID NO: 1469) | ACTGCAACTTTCATGACAGGTTGGGACCGGCTTAATCCATAGGCTGTTCC (SEQ ID NO: 1470) |
| PDIA4 | NM_004911.4 | TGAAGCCAGTCATCAAATCCCAGCCAGT | GGGTCCCTTGTTGTTCTTGGGCACTG | TTGGGGTCCATCACAATGGAGTCA |

TABLE 1-continued

| Gene | GenBank Accession No. | Target Sequence | Capture Probe Sequence | Reporter Probe Sequence |
|---|---|---|---|---|
| | | GCCCAAGAACAAC AAGGGACCCGTCA AGGTCGTGGTGGG AAAGACCTTTGACT CCATTGTGATGGAC CCCAA (SEQ ID NO: 1471) | GCTGGGATTTGAT GACTGG (SEQ ID NO: 1472) | AAGGTCTTTCCC ACCACGACCTTG AC (SEQ ID NO: 1473) |
| PDIA5 | NM_006810.2 | GCTACCCCACTTTC CACTACTACCACTA TGGGAAGTTCGCAG AAAAGTATGACAG CGACCGCACAGAA TTGGGATTTACCAA TTATATTCGAGCCC TCCG (SEQ ID NO: 1474) | ATACTTTTCTGCG AACTTCCCATAGT GGTAGTAGTGGA AAGTGGGGTAGC (SEQ ID NO: 1475) | CGGAGGGCTCGA ATATAATTGGTA AATCCCAATTCT GTGCGGTCGCTG TC (SEQ ID NO: 1476) |
| PDK4 | NM_002612.3 | AATCAGAACACTG ATCCAATGAGGAAT GGAGCTTGTTTCTG TGACCCAGGAGAA CTTAGTGCAAGACT ACAGGAGTTAACA GATGGCCAGCTCCT TATTT (SEQ ID NO: 1477) | CCTGGGTCACAG AAACAAGCTCCA TTCCTCATTGGAT CAGTGTTCTGATT (SEQ ID NO: 1478) | AAATAAGGAGCT GGCCATCTGTTA ACTCCTGTAGTC TTGCACTAAGTT CT (SEQ ID NO: 1479) |
| PDLIM1 | NM_020992.2 | GGATCCCAACAAG CCCTCAGGATTCAG AAGTGTTAAAGCTC CTGTCACTAAAGTG GCTGCGTCGATTGG AAATGCTCAGAAGT TGCCTATGTGTGAC AAA (SEQ ID NO: 1480) | TAGTGACAGGAG CTTTAACACTTCT GAATCCTGAGGG CTTGTTGGGATC (SEQ ID NO: 1481) | TTTGTCACACAT AGGCAACTTCTG AGCATTTCCAAT CGACGCAGCCAC TT (SEQ ID NO: 1482) |
| PDLIM3 | NM_001114107.2 | CTTTGGGACAGAGT CCATGACTCATGCT GATGCGCAGGACA GGATTAAAGCAGC AGCTCACCAGCTGT GTCTCAAAATTGAC AGGGGAGAAACTC ACTTA (SEQ ID NO: 1483) | CTTTAATCCTGTC CTGCGCATCAGC ATGAGTCATGGA CTCTG (SEQ ID NO: 1484) | TAAGTGAGTTTC TCCCCTGTCAAT TTTGAGACACAG CTGGTGAGCTGC TG (SEQ ID NO: 1485) |
| PDPN | NM_006474.4 | CTCCAGGAACCAGC GAAGACCGCTATA AGTCTGGCTTGACA ACTCTGGTGGCAAC AAGTGTCAACAGTG TAACAGGCATTCGC ATCGAGGATCTGCC AAC (SEQ ID NO: 1486) | CACCAGAGTTGT CAAGCCAGACTT ATAGCGGTCTTCG CTGGTTCC (SEQ ID NO: 1487) | GTTGGCAGATCC TCGATGCGAATG CCTGTTACACTG TTGACACTTGTT GC (SEQ ID NO: 1488) |
| PECAM1 | NM_000442.3 | ATCTGCACTGCAGG TATTGACAAAGTGG TCAAGAAAAGCAA CACAGTCCAGATAG TCGTATGTGAAATG CTCTCCCAGCCCAG GATTTCTTATGATG CCC (SEQ ID NO: 1489) | TGGACTGTGTTGC TTTTCTTGACCAC TTTGTCAATACCT GCAGTG (SEQ ID NO: 1490) | GGGCATCATAAG AAATCCTGGGCT GGGAGAGCATTT CACATACGACTA TC (SEQ ID NO: 1491) |
| PECR | NM_018441.5 | CATTGTCCCTACTA AGCTGGATTTCCA TTAGCTGTGCATTC TGGAGCTGCAAGA GCAGGTGTTTACAA CCTCACCAAATCTT TAGCTTTGGAATGG GCC (SEQ ID NO: 1492) | CAGCTCCAGAAT GCACAGCTAATG GAAATCCAGCTTT AGTAGGGACAAT G (SEQ ID NO: 1493) | GGCCCATTCCAA AGCTAAAGATTT GGTGAGGTTGTA AACACCTGCTCT TG (SEQ ID NO: 1494) |

TABLE 1-continued

| Gene | GenBank Accession No. | Target Sequence | Capture Probe Sequence | Reporter Probe Sequence |
|---|---|---|---|---|
| PGAM1 | NM_002629.2 | ATGGAAAAGCTCCC CTTATCCAACAGAG TTTAAAAGTAGTGA CTTGGGTTTTTGCG AGTGCTTTGTTTAC TAAGGACTTTGGGG AGGAACCATGCTA AGC (SEQ ID NO: 1495) | AACCCAAGTCAC TACTTTTAAACTC TGTTGGATAAGG GGAGCTTTTCCAT (SEQ ID NO: 1496) | GCTTAGCATGGT TCCTCCCCAAAG TCCTTAGTAAAC AAAGCACTCGCA AA (SEQ ID NO: 1497) |
| PHAX | NM_032177.3 | GAAAAAAACATTC CCAGTGGCAGCCTG CCTAAGACTGTCTT ACCTTATGTTAAGG AAGTCAGGTATTTA AAATGTTACATATG CCGGCGCAGTGGCT CAT (SEQ ID NO: 1498) | ACATAAGGTAAG ACAGTCTTAGGC AGGCTGCCACTG GGAATGTTTTTT C (SEQ ID NO: 1499) | ATGAGCCACTGC GCCGGCATATGT AACATTTTAAAT ACCTGACTTCCT TA (SEQ ID NO: 1500) |
| PHC3 | NM_024947.3 | CTACATCTCCCACA GGAAGTGTCACAC AGCAGTCAAGTATG TCCCAAACGTCTAT CAACCTCTCCACTT CTCCTACACCTGCA CAGTTAATAAGCCG TTC (SEQ ID NO: 1501) | CGTTTGGGACAT ACTTGACTGCTGT GTGACACTTCCTG TGGGAGA (SEQ ID NO: 1502) | GAACGGCTTATT AACTGTGCAGGT GTAGGAGAAGT GGAGAGGTTGAT AGA (SEQ ID NO: 1503) |
| PHF16 | NM_014735.3 | GTAGCCTTTGTCCC TTCATGCCTTTCAA TTCTGAGTGGGAGG AAAAGCAAACATC AAAACAGTGCTTCA GCCAAATTCCATAT GTAATGCCATTGGG AGA (SEQ ID NO: 1504) | TTGCTTTTCCTCC CACTCAGAATTG AAAGGCATGAAG GGACAAAGGCTA C (SEQ ID NO: 1505) | TCTCCCAATGGC ATTACATATGGA ATTTGGCTGAAG CACTGTTTTGAT GT (SEQ ID NO: 1506) |
| PHF23 | NM_024297.2 | CTGTCTGTGTCCCG ACACATAATCTCTG TCTCTTGGACCTGC CACCATCACTTTCT GGGTCAGGATTGG AATTGGGATGGAAT GGGACAGTTGTCTA TAA (SEQ ID NO: 1507) | TGATGGTGGCAG GTCCAAGAGACA GAGATTATGTGTC GGGACACAGACA G (SEQ ID NO: 1508) | TTATAGACAACT GTCCCATTCCAT CCCAATTCCAAT CCTGACCCAGAA AG (SEQ ID NO: 1509) |
| PIK3CA | NM_006218.2 | CCTCAGGCTTGAAG AGTGTCGAATTATG TCCTCTGCAAAAAG GCCACTGTGGTTGA ATTGGGAGAACCC AGACATCATGTCAG AGTTACTGTTTCAG AAC (SEQ ID NO: 1510) | ACAGTGGCCTTTT TGCAGAGGACAT AATTCGACACTCT TCAAGCCTGAGG (SEQ ID NO: 1511) | GTTCTGAAACAG TAACTCTGACAT GATGTCTGGGTT CTCCCAATTCAA CC (SEQ ID NO: 1512) |
| PIK3CD | NM_005026.3 | TGACACTCATTGAT TCTAAAGCATCTTT AATCTGCCAGGCGG AGGGGGCTTTGCTG GTCTTTCTTGGACT ATTCCAGAGAGGA CAACTGTCATCTGG GAA (SEQ ID NO: 1513) | AGCCCCCTCCGCC TGGCAGATTAAA GATGCTTTAGAAT CAATGAGTG (SEQ ID NO: 1514) 1515) | TTCCCAGATGAC AGTTGTCCTCTC TGGAATAGTCCA AGAAAGACCAG CAA (SEQ ID NO: |
| PIM1 | NM_002648.2 | CTTCATCATGAGTT CTGCTGAATGCCGC | TTTCCCCCCTACC TGACCCATCGCG | AGAGGTGACAG GGACTTAAAATG |

TABLE 1-continued

| Gene | GenBank Accession No. | Target Sequence | Capture Probe Sequence | Reporter Probe Sequence |
|---|---|---|---|---|
| | | GATGGGTCAGGTA GGGGGGAAACAGG TTGGGATGGGATAG GACTAGCACCATTT TAAGTCCCTGTCAC CTCT (SEQ ID NO: 1516) | GCATTCAGCAGA ACTCATGATGAA G (SEQ ID NO: 1517) | GTGCTAGTCCTA TCCCATCCCAAC CTG (SEQ ID NO: 1518) |
| PIM2 | NM_006875.2 | GCCATCCAGCACTG CCATTCCCGTGGAG TTGTCCATCGTGAC ATCAAGGATGAGA ACATCCTGATAGAC CTACGCCGTGGCTG TGCCAAACTCATTG ATT (SEQ ID NO: 1519) | TCCTTGATGTCAC GATGGACAACTC CACGGGAATGGC AGTGCTGGATG (SEQ ID NO: 1520) | AATCAATGAGTT TGGCACAGCCAC GGCGTAGGTCTA TCAGGATGTTCT CA (SEQ ID NO: 1521) |
| PLAU | NM_002658.2 | TTCATTGATTACCC AAAGAAGGAGGAC TACATCGTCTACCT GGGTCGCTCAAGGC TTAACTCCAACACG CAAGGGGAGATGA AGTTTGAGGTGGAA AACC (SEQ ID NO: 1522) | GAGCGACCCAGG TAGACGATGTAG TCCTCCTTCTTTG GGTAATCAATGA A (SEQ ID NO: 1523) | GGTTTTCCACCT CAAACTTCATCT CCCCTTGCGTGT TGGAGTTAAGCC TT (SEQ ID NO: 1524) |
| PLEK | NM_002664.2 | AAATGATATTGCGT TCGTGCCTCAGCTT TAAGCACAAGTAG CAGCAGCTCCTGCT TGAGTTCTGAGGGC ATCATGGCCCTATG ATTAACCAGAGTGA TCT (SEQ ID NO: 1525) | GAGCTGCTGCTA CTTGTGCTTAAAG CTGAGGCACGAA CGCAATATCATTT (SEQ ID NO: 1526) | AGATCACTCTGG TTAATCATAGGG CCATGATGCCCT CAGAACTCAAGC AG (SEQ ID NO: 1527) |
| PLEKHF2 | NM_024613.2 | ATCGTCGCCACCAT TGCCGCAAATGTGG TTTTGTTGTCTGTG GGCCCTGCTCTGAA AAGAGATTTCTTCT TCCCAGCCAGTCCT CTAAGCCTGTGCGG AT (SEQ ID NO: 1528) | GCAGGGCCCACA GACAACAAAACC ACATTTGCGGCA ATGGTGGCGACG AT (SEQ ID NO: 1529) | ATCCGCACAGGC TTAGAGGACTGG CTGGGAAGAAG AAATCTCTTTTC AGA (SEQ ID NO: 1530) |
| PLEKHG4B | NM_052909.3 | CGGTTTCAGCAGGT CCCATGTAGTTAGC AGGACAGCACTTG AGTTAGGTCTGAGA AAGAACGCCTGTTT GTCATGGCATTTCC TGTAAGGAGCCCA GAGC (SEQ ID NO: 1531) | GACCTAACTCAA GTGCTGTCCTGCT AACTACATGGGA CCTGCTGAAACC G (SEQ ID NO: 1532) | CTCTGGGCTCCT TACAGGAAATGC CATGACAAACAG GCGTTCTTTCTC A (SEQ ID NO: 1533) |
| PLXNB1 | NM_001130082.1 | CCAACAGCTTGCCT CTGAGGTTCTGGAT CAATATAATAAAA AACCCGCAGTTTGT GTTCGACGTGCAAA CATCTGATAACATG GATGCGGTGCTCCT TGT (SEQ ID NO: 1534) | CTGCGGGTTTTTT ATTATATTGATCC AGAACCTCAGAG GCAAGCTGTTGG (SEQ ID NO: 1535) | ACAAGGAGCAC CGCATCCATGTT ATCAGATGTTTG CACGTCGAACAC AAA (SEQ ID NO: 1536) |
| PMCHL1 | NM_031887.2 | CGGGGGAAAGCCC ATCCGTACTACCAG GAGACTGGATCCGC AAAGTAGACACTTG GTCTCATGAAGCCA CTGCTGGGCTCCAG AGAGAAGGGAAAA CTAA (SEQ ID NO: 1537) | GTCTACTTTGCGG ATCCAGTCTCCTG GTAGTACGGATG GG (SEQ ID NO: 1538) | TCTCTGGAGCCC AGCAGTGGCTTC ATGAGACCAAGT (SEQ ID NO: 1539) |

TABLE 1-continued

| Gene | GenBank Accession No. | Target Sequence | Capture Probe Sequence | Reporter Probe Sequence |
|---|---|---|---|---|
| PMEPA1 | NM_020182.3 | GCTGAGACAGTCCTCATATCCTCTTGAGCCAAACTGTTTGGGTCTCGTTGCTTCATGGTATGGTCTGGATTTGTGGGAATGGCTTTGCGTGAGAAAGGGG (SEQ ID NO: 1540) | CAACGAGACCCAAACAGTTTGGCTCAAGAGGATATGAGGACTGTCTCAGC (SEQ ID NO: 1541) | CCCCTTTCTCACGCAAAGCCATTCCCACAAATCCAGACCATACCATGAAG (SEQ ID NO: 1542) |
| PMP22 | NM_000304.2 | GTCTAGGCTGTTCTGTGCCTCCAAGGACTGTCTGGCAATGACTTGTATTGGCCACCAACTGTAGATGTATATATGGTGCCCTTCTGATGCTAAGACTCCA (SEQ ID NO: 1543) | CAATACAAGTCATTGCCAGACAGTCCTTGGAGGCACAGAACAGCCTAGAC (SEQ ID NO: 1544) | AGTCTTAGCATCAGAAGGGCACCATATATACATCTACAGTTGGTGGC (SEQ ID NO: 1545) |
| PNLIP | NM_000936.2 | GAAAACAGTTCAACTTCTGTAGTCCAGAAACCGTCAGGGAGGAAGTTCTGCTCACCCTCACACCGTGTTAGGAGACTACTGTTATTTGACCAATGAATTG (SEQ ID NO: 1546) | CAGAACTTCCTCCCTGACGGTTTCTGGACTACAGAAGTTGAACTGTTTTC (SEQ ID NO: 1547) | CAATTCATTGGTCAAATAACAGTAGTCTCCTAACACGGTGTGAGGGTGAG (SEQ ID NO: 1548) |
| PNP | NM_000270.3 | CGCTGTTGGCATGAGTACAGTACCAGAAGTTATCGTTGCACGGCACTGTGGACTTCGAGTCTTTGGCTTCTCACTCATCACTAACAAGGTCATCATGGAT (SEQ ID NO: 1549) | CACAGTGCCGTGCAACGATAACTTCTGGTACTGTACTCATGCCAACAGCG (SEQ ID NO: 1550) | ATCCATGATGACCTTGTTAGTGATGAGTGAGAAGCCAAAGACTCGAAGTC (SEQ ID NO: 1551) |
| POU2AF1 | NM_006235.2 | CCCTGATGCCAGAGTCCTTGAGCTGTCAGTTCCCACAGTTGCTCCTTTGTTTGCTCTTCTCAGCCTCGGCCAGATTTACAGTCCAGGCAGCAAAATCTCA (SEQ ID NO: 1552) | ACAAAGGAGCAACTGTGGGAACTGACAGCTCAAGGACTCTGGCATCAGGG (SEQ ID NO: 1553) | TGAGATTTTGCTGCCTGGACTGTAAATCTGGCCGAGGCTGAGAAGAGCAA (SEQ ID NO: 1554) |
| POU2F1 | NM_002697.2 | GCTATGGGGAAACTATATGGAAATGACTTCAGCCAAACTACCATCTCTCGATTTGAAGCCTTGAACCTCAGCTTTAAGAACATGTGCAAGTTGAAGCCAC (SEQ ID NO: 1555) | CGAGAGATGGTAGTTTGGCTGAAGTCATTTCCATATAGTTTCCCCATAGC (SEQ ID NO: 1556) | GTGGCTTCAACTTGCACATGTTCTTAAAGCTGAGGTTCAAGGCTTCAAT (SEQ ID NO: 1557) |
| POU2F2 | NM_002698.2 | ATGGGGCCTGGCACCTCGTCTACCCAACCTCACCGGAATGTAAGCATCTCCGCTGAACGACTCCCTGCCCTTACCCTACCTCTGAGTTTGTCCATGTTTA (SEQ ID NO: 1558) | GAGATGCTTACATTCCGGTGAGGTTGGGTAGACGAGGTGCCAGG (SEQ ID NO: 1559) | TAAACATGGACAAACTCAGAGGTAGGGTAAGGGCAGGGAGTCGTTCAGCG (SEQ ID NO: 1560) |
| PPA1 | NM_021129.3 | ATACTGGCTGTTGTGGTGACAATGACCC | TCCAATTTCACACACATCAATTGGG | ATGCCTAGAACTTTCACGCCAATT |

TABLE 1-continued

| Gene | GenBank Accession No. | Target Sequence | Capture Probe Sequence | Reporter Probe Sequence |
|---|---|---|---|---|
| | | AATTGATGTGTGTG AAATTGGAAGCAA GGTATGTGCAAGA GGTGAAATAATTGG CGTGAAAGTTCTAG GCAT (SEQ ID NO: 1561) | TCATTGTCACCAC AACAGCCAGTAT (SEQ ID NO: 1562) | ATTTCACCTCTT GCACATACCTTG CT (SEQ ID NO: 1563) |
| PPP2R3B | NM_199326.1 | CCCTGACATGCATC TTCGTCTCTCCATC CTGGCTTTCGATCT AGAGGCAGAAAAG TGCAGAAGGAAGG GAAGATCAGCTATG CCGACTTTGTCTGG TTTT (SEQ ID NO: 1564) | CTGCCTCTAGATC GAAAGCCAGGAT GGAGAGACGAAG ATGCATGTCAGG G (SEQ ID NO: 1565) | AAAACCAGACA AAGTCGGCATAG CTGATCTTCCCT TCCTTCTGCACT TTT (SEQ ID NO: 1566) |
| PPP3CC | NM_005605.3 | AGCAGAAGGAAGC ACTACAGTTCGTAA GGAGATCATCAGG AATAAGATCAGAG CCATTGGGAAGATG GCACGGGTCTTTTC AATTCTTCGGCAAG AAAGT (SEQ ID NO: 1567) | TGATCTTATTCCT GATGATCTCCTTA CGAACTGTAGTG CTTCCTTCTG (SEQ ID NO: 1568) | ACTTTCTTGCCG AAGAATTGAAA AGACCCGTGCCA TCTTCCCAATGG CTC (SEQ ID NO: 1569) |
| PPPDE2 | NM_015704.2 | CAAGACCCACTGAT TTGCCAGTGTGCAT GGAAATAATAGATT AGAGCAGAAACTA GCAGGGACTGTTGT ATAATCGTGATCTA CTAGCAGAATTGGG CCC (SEQ ID NO: 1570) | TCTGCTCTAATCT ATTATTTCCATGC ACACTGGCAAAT CAGTGGGTCTTG (SEQ ID NO: 1571) | GCCCAATTCTGC TAGTAGATCACG ATTATACAACAG TCCCTGCTAGTT (SEQ ID NO: 1572) |
| PRDM1 | NM_182907.1 | CATCCCTGCCAACC AGGAACTTCTTGTG TGGTATTGTCGGGA CTTTGCAGAAAGGC TTCACTACCCTTAT CCCGGAGAGCTGA CAATGATGAATCTC ACA (SEQ ID NO: 1573) | CTGCAAAGTCCC GACAATACCACA CAAGAAGTTCCT GGTTGGCAGGGA TG (SEQ ID NO: 1574) | TGTGAGATTCAT CATTGTCAGCTC TCCGGGATAAGG GTAGTGAAGCCT TT (SEQ ID NO: 1575) |
| PRDM12 | NM_021619.2 | CCACACTTCCCTCG GTCCCTGCCCGTTT CCTCAAATTCGGGC CGTGCGCGCCCTCT GGTGTCGCCTCTCA CACTTTGCAGTCAT TTACCAGGATTCCC GT (SEQ ID NO: 1576) | CGCGCACGGCCC GAATTTGAGGAA ACGGGCAGGGAC CGAGGGAAGTG (SEQ ID NO: 1577) | ACGGGAATCCTG GTAAATGACTGC AAAGTGTGAGA GGCGACACCAG AGGG (SEQ ID NO: 1578) |
| PRDX2 | NM_005809.4 | GCATGGGGAAGTTT GTCCCGCTGGCTGG AAGCCTGGCAGTG ACACGATTAAGCCC AACGTGGATGACA GCAAGGAATATTTC TCCAAACACAATTA GGCT (SEQ ID NO: 1579) | TAATCGTGTCACT GCCAGGCTTCCA GCCAGCGGGACA AAC (SEQ ID NO: 1580) | AGCCTAATTGTG TTTGGAGAAATA TTCCTTGCTGTC ATCCACGTTGGG CT (SEQ ID NO: 1581) |
| PRDX4 | NM_006406.1 | AGGAGGACTTGGG CCAATAAGGATTCC ACTTCTTTCAGATT TGACCCATCAGATC TCAAAGGACTATGG TGTATACCTAGAGG ACTCAGGCCACACT TTTT (SEQ ID NO: 1582) | GATGGGTCAAAT CTGAAAGAAGTG GAATCCTTATTGG CCCAAGTCCTCCT (SEQ ID NO: 1583) | CCTGAGTCCTCT AGGTATACACCA TAGTCCTTTGAG ATCT (SEQ ID NO: 1584) |

TABLE 1-continued

| Gene | GenBank Accession No. | Target Sequence | Capture Probe Sequence | Reporter Probe Sequence |
|---|---|---|---|---|
| PRICKLE1 | NM_153026.1 | AGTTTCCTGGCCTCTCAGGCAATGCTGATGACACCCTTTCTCGAAAATTGGATGATCTGAGTCTCTCCAGACAAGGAACAAGTTTTGCCAGTGAAGAATT (SEQ ID NO: 1585) | CAATTTTCGAGAAAGGGTGTCATCAGCATTGCCTGAGAGGCCAGGAAACT (SEQ ID NO: 1586) | AATTCTTCACTGGCAAAACTTGTCCTTGTCTGGAGAGACTCAGATCATC (SEQ ID NO: 1587) |
| PRKCB | NM_212535.1 | GCATTTGGAGTCCTGCTGTATGAAATGTTGGCTGGGCAGGCACCCTTTGAAGGGGAGGATGAAGATGAACTCTTCCAATCCATCATGGAACACAACGTAG (SEQ ID NO: 1588) | TCAAAGGGTGCCTGCCCAGCCAACATTTCATACAGCAGGACTCCAAATGC (SEQ ID NO: 1589) | CTACGTTGTGTTCCATGATGGATTGGAAGAGTTCATCTTCATCCTCCCCT (SEQ ID NO: 1590) |
| PRMT1 | NM_198319.2 | ACTGCATCATGGAGAATTTTGTAGCCACCTTGGCTAATGGGATGAGCCTCCAGCCGCCTCTTGAAGAAGTAACCCCCCTTTGCCCTTCCCTGTGTCTGCC (SEQ ID NO: 1591) | GAGGCTCATCCCATTAGCCAAGGTGGCTACAAAATTCTCCATGATGCAGT (SEQ ID NO: 1592) | GCAGACACAGGGAAGGGCAAAGGGGGGTTACTTCTTCAAGAGGCGGCTG (SEQ ID NO: 1593) |
| PRPSAP2 | NM_002767.2 | AGACCTCTTGTGCCAAGAGCATCATTGGCGTGATACCCTACTTTCCTTACAGCAAGCAGTGCAAGATGAGAAAAAGAGGCTCCATTGTCTCTAAATTGCT (SEQ ID NO: 1594) | GTAAGGAAAGTAGGGTATCACGCCAATGATGCTCTTGGCACAAGAGGTCT (SEQ ID NO: 1595) | AGCAATTTAGAGACAATGGAGCCTCTTTTTCTCATCTTGCACTGCTTGCT (SEQ ID NO: 1596) |
| PRSS1 | NM_002769.3 | GTAATCAACGCCCGCGTGTCCACCATCTCTCTGCCCACCGCCCCTCCAGCCACTGGCACGAAGTGCCTCATCTCTGGCTGGGCAACACTGCGAGCTCTG (SEQ ID NO: 1597) | GCTGGAGGGGCGGTGGGCAGAGAGATGGTGGACACGCGG (SEQ ID NO: 1598) | TTGCCCCAGCCAGAGATGAGGCACTTCGTGCCAGTG (SEQ ID NO: 1599) |
| PSMG1 | NM_003720.2 | AAAATCCAATCCCTCGGTTTTTCTCTGTCAGTGCAGTTGCTATGTTGCAGAAGATCAACAGTATCAGTGGCTGGAAAAGGTTTTTGGCTCTTGTCCAAGG (SEQ ID NO: 1600) | CTGCAACATAGCAACTGCACTGACAGAGAAAAACCGAGGGATTGGATTTT (SEQ ID NO: 1601) | CCTTGGACAAGAGCCAAAAACCTTTTCCAGCCACTGATACTGTTGATCTT (SEQ ID NO: 1602) |
| PTEN | NM_000314.3 | TGTGGTCTGCCAGCTAAAGGTGAAGATATATTCCTCCAATTCAGGACCCACACGACGGGAAGACAAGTTCATGTACTTTGAGTTCCCTCAGCCGTTACCT (SEQ ID NO: 1603) | TGGGTCCTGAATTGGAGGAATATATCTTCACCTTTAGCTGGCAGACCACA (SEQ ID NO: 1604) | AGGTAACGGCTGAGGGAACTCAAAGTACATGAACTTGTCTTCCCGTCGTG (SEQ ID NO: 1605) |
| PTENP1 | NR_023917.1 | ACCACAATGAGATGACACTACACATTT | TTTTTAATAATCATCATTCTGGCAAA | TCAATGTGTGAGGTTCCAGTTTTTT |

TABLE 1-continued

| Gene | GenBank Accession No. | Target Sequence | Capture Probe Sequence | Reporter Probe Sequence |
|---|---|---|---|---|
| | | GCCAGAATGATGAT TATTAAAAAAGACC AAGTATTGGAGAG GATGTGAAAAAAC TGGAACCTCACACA TTGAC (SEQ ID NO: 1606) | TGTGTAGTGTCAT CTCATTGTGGT (SEQ ID NO: 1607) | CACATCCTCTCC AATACTTGGTCT (SEQ ID NO: 1608) |
| PTGER4 | NM_000958.2 | CGCGGGCGCCGAG ATCCAGATGGTCAT CTTACTCATTGCCA CCTCCCTGGTGGTG CTCATCTGCTCCAT CCCGCTCGTGGTGC GAGTATTCGTCAAC CAG (SEQ ID NO: 1609) | CCAGGGAGGTGG CAATGAGTAAGA TGACCATCTGGAT CTCGG (SEQ ID NO: 1610) | CTGGTTGACGAA TACTCGCACCAC GAGCGGGATGG AGCAGATGAGC ACCA (SEQ ID NO: 1611) |
| PTGIR | NM_000960.3 | CTGACATTTCAAGC TGACCCTGTGATCT CTGCCCTGTCTTCG GGCGACAGGAGCC AGAAAATCAGGGA CATGGCTGATGGCT GCGGATGCTGGAA CCTTG (SEQ ID NO: 1612) | CTGTCGCCCGAA GACAGGGCAGAG ATCACAGGGTCA GCTTGAAATG (SEQ ID NO: 1613) | CGCAGCCATCAG CCATGTCCCTGA TTTTCTGGCTC (SEQ ID NO: 1614) |
| PTK2 | NM_005607.3 | GGTTCAAGCTGGAT TATTTCAGTGGAAC TGGCAATCGGCCCA GAAGAAGGAATCA GTTACCTAACGGAC AAGGGCTGCAATCC CACACATCTTGCTG ACT (SEQ ID NO: 1615) | CCTTCTTCTGGGC CGATTGCCAGTTC CACTGAAATAAT CCAGCTTGAACC (SEQ ID NO: 1616) | AGTCAGCAAGAT GTGTGGGATTGC AGCCCTTGTCCG TTAGGTAACTGA TT (SEQ ID NO: 1617) |
| PTPN1 | NM_002827.2 | AGTGACTTCCCATG TAGAGTGGCCAAG CTTCCTAAGAACAA AAACCGAAATAGG TACAGAGACGTCA GTCCCTTTGACCAT AGTCGGATTAAACT ACATC (SEQ ID NO: 1618) | TTTCGGTTTTTGT TCTTAGGAAGCTT GGCCACTCTACAT GGGAAGT (SEQ ID NO: 1619) | GATGTAGTTTAA TCCGACTATGGT CAAAGGGACTG ACGTCTCTGTAC CTA (SEQ ID NO: 1620) |
| PTPN21 | NM_007039.3 | ATTGGAGCGTGTCT TGAAGGTATCTTTG TGAAACACAAGAA TGGAAGGCATCCTG TGGTATTTAGGTGG CATGACATTGCCAA CATGTCCCACAACA AGT (SEQ ID NO: 1621) | TGCCTTCCATTCT TGTGTTTCACAAA GATACCTTCAAG ACACGCTCCAAT (SEQ ID NO: 1622) | ACTTGTTGTGGG ACATGTTGGCAA TGTCATGCCACC TAAATACCACAG GA (SEQ ID NO: 1623) |
| PTPRB | NM_002837.3 | CTTGTAAATACCGC AACCGAGTATCGAT TTACTTCCCTAACA CCAGGCCGCCAATA CAAAATTCTTGTCT TGACGATTAGCGGG GATGTACAGCAGTC AG (SEQ ID NO: 1624) | CGGCCTGGTGTTA GGGAAGTAAATC GATACTCGGTTGC GGTATTTACAAG (SEQ ID NO: 1625) | CTGACTGCTGTA CATCCCCGCTAA TCGTCAAGACAA GAATTTTGTATT GG (SEQ ID NO: 1626) |
| PTRH1 | NM_001002913.1 | CCCGGCGCACCCTG AGGCGGTTCAGGCC CATGTGCTGGGCTG CTTCTCCCCTGCTG AGCAGGAGCTGCT GCCTCTGTTGCTGG ATCGAGCCACCGAC CTG (SEQ ID NO: 1627) | GGGAGAAGCAGC CCAGCACATGGG CCTGAACCGCC (SEQ ID NO: 1628) | ATCCAGCAACAG AGGCAGCAGCTC CTGCTCAGCAG (SEQ ID NO: 1629) |

TABLE 1-continued

| Gene | GenBank Accession No. | Target Sequence | Capture Probe Sequence | Reporter Probe Sequence |
|---|---|---|---|---|
| PVRL1 | NM_002855.4 | GTTAAGCGGGGCCTTGGGCAGTGTTTTCCTGCTGAGGGTGGTTTTACATTTTTTTCCTCATTGGCCCACAGAGAGTGGAGTTGGCCTAGCTCTGACGCG (SEQ ID NO: 1630) | AATGTAAAACCACCCTCAGCAGGAAAACACTGCCCAAGGCCCCGCTTAAC (SEQ ID NO: 1631) | CGCGTCAGAGCTAGGCCAACTCCACTCTCTGTGGGCCAATGAGGAAAAAA (SEQ ID NO: 1632) |
| PXDN | NM_012293.1 | GCGACTGTTGACAGAGCTATAAACTCAACCCGAACACATTTGTTTGACAGCCGTCCTCGTTCTCCAAATGATTTGCTGGCCTTGTTCCGGTATCCGAGGG (SEQ ID NO: 1633) | CTGTCAAACAAATGTGTTCGGGTTGAGTTTATAGCTCTGTCAACAGTCGC (SEQ ID NO: 1634) | CCCTCGGATACCGGAACAAGGCCAGCAAATCATTTGGAGAACGAGGACGG (SEQ ID NO: 1635) |
| QSOX1 | NM_002826.4 | TAGGGCAGCTCAGTCCCTGGCCTCTTAGCACCACATTCCTGTTTTTCAGCTTATTTGAAGTCCTGCCTCATTCTCACTGGAGCCTCAGTCTCTCCTGCTT (SEQ ID NO: 1636) | GCTGAAAAACAGGAATGTGGTGCTAAGAGGCCAGGGACTGAGCTGCCCTA (SEQ ID NO: 1637) | AAGCAGGAGAGACTGAGGCTCCAGTGAGAATGAGGCAGGACTTCAATAA (SEQ ID NO: 1638) |
| R3HDM1 | NM_015361.2 | CCTGTGTTCCCAAGAGAATTACATTATTGACAAAAGACTCCAAGACGAGGATGCCAGTAGTACCCAGCAGAGGCGCCAGATATTTAGAGTTAATAAAGAT (SEQ ID NO: 1639) | CCTCGTCTTGGAGTCTTTTGTCAATAATGTAATTCTCTTGGGAACACAGG (SEQ ID NO: 1640) | ATCTTTATTAACTCTAAATATCTGGCGCCTCTGCTGGGTACTACTGGCAT (SEQ ID NO: 1641) |
| RAB20 | NM_017817.1 | AGACCGGCTACAATGTGGACCTCCTGTTTGAGACCCTCTTTGACCTGGTGGTGCCAATGATCTTACAGCAGAGAGCTGAGAGGCCGTCACACACAGTGGA (SEQ ID NO: 1642) | CACCAGGTCAAAGAGGGTCTCAAACAGGAGGTCCACATTGTAGCCGG (SEQ ID NO: 1643) | GACGGCCTCTCAGCTCTCTGCTGTAAGATCATTGGCAC (SEQ ID NO: 1644) |
| RAB31 | NM_006868.3 | TTTTGTAAAGAGCTTCCATCTGGGCTGGACCCAGTTCTTGCACATACAAGACACCGCTGCAGTCAGCTAGGACCTTTCCGCCATGTATTCTATTCTGTAG (SEQ ID NO: 1645) | CTTGTATGTGCAAGAACTGGGTCCAGCCCAGATGGAAGCTCT1TACAAAA (SEQ ID NO: 1646) | CTACAGAATAGAATACATGGCGGAAAGGTCCTAGCTGACTGCAGCGGTGT (SEQ ID NO: 1647) |
| RAB33A | NM_004794.2 | GGGAGAAGACCGTGGAAATCGAGGGCGAGAAGATCAAGGTTCAGGTGTGGGACACAGCAGGTCAGGAACGTTTCCGCAAAAGCATGGTCGAGCATTACTA (SEQ ID NO: 1648) | CCACACCTGAACCTTGATCTTCTCGCCCTCGATTTCCACG (SEQ ID NO: 1649) | TAGTAATGCTCGACCATGCTTTGCGGAAACGTTCCTGACCTGCTGTGTC (SEQ ID NO: 1650) |
| RAB3A | NM_002866.4 | CGCCACAGACTCGCGCTATGGGCAGAA | CGAAGTTCTGATCCGAGGACTCCTTC | CGTCTTGCCCACGCTGCTGTTGCC |

TABLE 1-continued

| Gene | GenBank Accession No. | Target Sequence | Capture Probe Sequence | Reporter Probe Sequence |
|---|---|---|---|---|
| | | GGAGTCCTCGGATC AGAACTTCGACTAC ATGTTCAAGATTCT CATCATCGGCAACA GCAGCGTGGGCAA GACG (SEQ ID NO: 1651) | TGCCCATAGCGC GA (SEQ ID NO: 1652) | GATGATGAGAAT CTTGAACATGTA GT (SEQ ID NO: 1653) |
| RAB7L1 | NM_001135664.1 | CATTTGAATTGTCT CCTGACTACTGTCC AGTAAGGAGGCCC ATTGTCACTTAGAA AAGACACCTGGAA CCCATGTGCATTTC TGCATCTCCTGGAT TAGC (SEQ ID NO: 1654) | AGTGACAATGGG CCTCCTTACTGGA CAGTAGTCAGGA GACAATTCAAAT G (SEQ ID NO: 1655) | CTAATCCAGGAG ATGCAGAAATGC ACATGGGTTCCA GGTGTCTTTTCT A (SEQ ID NO: 1656) |
| RANBP9 | NM_005493.2 | TTGAAGGATGCATT CAGTCTACTAGCAT ATTCAGATCCCTGG AACAGCCCAGTTGG AAATCAGCTTGACC CGATTCAGAGAGA ACCTGTGTGCTCAG CTC (SEQ ID NO: 1657) | GGGCTGTTCCAG GGATCTGAATAT GCTAGTAGACTG AATGCATCCTTCA A (SEQ ID NO: 1658) | TGAGCACACAGG TTCTCTCTGAAT CGGGTCAAGCTG ATTTCCAACT (SEQ ID NO: 1659) |
| RAPGEF5 | NM_012294.3 | GCATTTTGCGTACC TCATACAGGCTCCT TGCCCACACTATGG AATGACAGCAGCC AGTGCAGGGAGGT TAAGTGACATTTAA TGAGTGAAGCACTT AGCA (SEQ ID NO: 1660) | CTGTCATTCCATA GTGTGGGCAAGG AGCCTGTATGAG GTACGCAAAATG C (SEQ ID NO: 1661) | TGCTAAGTGCTT CACTCATTAAAT GTCACTTAACCT CCCTGCACTGGC TG (SEQ ID NO: 1662) |
| RARRES2 | NM_002889.3 | GAAACCCGAGTGC AAAGTCAGGCCCA ATGGGAGGAAACG GAAATGCCTGGCCT GCATCAAACTGGGC TCTGAGGACAAAGT TCTGGGCCGGTTGG TCCAC (SEQ ID NO: 1663) | CCAGGCATTTCCG TTTCCTCCCATTG GGCCTGACTTTGC ACTCGGGTTTC (SEQ ID NO: 1664) | CAACCGGCCCAG AACTTTGTCCTC AGAGCCCAGTTT GATGCAGG (SEQ ID NO: 1665) |
| RASGRP3 | NM_015376.2 | GCTGACTTGCATGA TTATGGAGATGGTC TATCTGATGCTGAA AATGTCTCTAGTTT TTTGACAACGGCTA AATAACCATGGGAT CAAGTGGCCTTGGG AA (SEQ ID NO: 1666) | GAGACATTTTCA GCATCAGATAGA CCATCTCCATAAT CATGCAAGTCAG C (SEQ ID NO: 1667) | TTCCCAAGGCCA CTTGATCCCATG GTTATTTAGCCG TTGTCAAAAAAC TA (SEQ ID NO: 1668) |
| RASSF4 | NM_032023.3 | TGAAGGAAGACTG TCTGCCGAGTTCTC ACGTGCCCATCAGT GACAGCAAGTCCAT TCAGAAGTCGGAG CTCTTAGGCCTGCT GAAAACCTACAACT GCTA (SEQ ID NO: 1669) | CTTGCTGTCACTG ATGGGCACGTGA GAACTCGGCAGA CAGTCTT (SEQ ID NO: 1670) | TAGCAGTTGTAG GTTTTCAGCAGG CCTAAGAGCTCC GACTTCTGAATG GA (SEQ ID NO: 1671) |
| RC3H2 | NM_018835.2 | AGATCCAATAATTC CCTTTAGTGATGGA CCCATCATCTCAAA ATGGGGTGCGATTT CCAGATCTTCCCGT ACAGGTTACCATAC CACAGATCCTGTCC AG (SEQ ID NO: 1672) | CACCCCATTTTGA GATGATGGGTCC ATCACTAAAGGG AATTATTGGATCT (SEQ ID NO: 1673) | CTGGACAGGATC TGTGGTATGTA ACCTGTACGGGA AGATCTGGAAAT CG (SEQ ID NO: 1674) |

TABLE 1-continued

| Gene | GenBank Accession No. | Target Sequence | Capture Probe Sequence | Reporter Probe Sequence |
|---|---|---|---|---|
| RCL1 | NM_005772.3 | TGGTGAATCATTTG AACTGAAGATTGTG CGACGGGGAATGC CTCCCGGAGGAGG AGGCGAAGTGGTTT TCTCATGTCCTGTG AGGAAGGTCTTGA AGCCC (SEQ ID NO: 1675) | CTCCGGGAGGCA TTCCCCGTCGCAC AATCTTCAGTTCA AATGATTCACCA (SEQ ID NO: 1676) | GGGCTTCAAGAC CTTCCTCACAGG ACATGAGAAAA CCACTTCGCCTC CTC (SEQ ID NO: 1677) |
| REL | NM_002908.2 | TGGCCTCCGGTGCG TATAACCCGTATAT AGAGATAATTGAA CAACCCAGGCAGA GGGGAATGCGTTTT AGATACAAATGTG AAGGGCGATCAGC AGGCAG (SEQ ID NO: 1678) | CCTGGGTTGTTCA ATTATCTCTATAT ACGGGTTATACG CACCGGAGGCCA (SEQ ID NO: 1679) | CTGCCTGCTGAT CGCCCTTCACAT TTGTATCTAAAA CGCATTCCCCTC TG (SEQ ID NO: 1680) |
| RETNLB | NM_032579.2 | TGACCTGACAGGG AGGAGGCTGAGAA CTCAGTTTTGTGAC CATGACAGTAATGA AACCAGGGTCCCA ACCAAGAAATCTA ACTCAAACGTCCCA CTTCAT (SEQ ID NO: 1681) | TACTGTCATGGTC ACAAAACTGAGT TCTCAGCCTCCTC CC (SEQ ID NO: 1682) | ATGAAGTGGGAC GTTTGAGTTAGA TTTCTTGGTTGG GACCCTGGTTTC AT (SEQ ID NO: 1683) |
| RFTN1 | NM_015150.1 | AGAGCCATCCTGAT CAAGAAAACCGAC AGATCTCAGAAAA CTGATCTTCACAAT GAAGGCTACATCTT GGAATTAGATTGCT GTTCCTCCTTAGAC CACC (SEQ ID NO: 1684) | TGAAGATCAGTTT TCTGAGATCTGTC GGTTTTCTTGATC AGGATGGCTCT (SEQ ID NO: 1685) | GGTGGTCTAAGG AGGAACAGCAA TCTAATTCCAAG ATGTAGCCTTCA TTG (SEQ ID NO: 1686) |
| RGL1 | NM_015149.3 | AGCCATGTGAATTC CACAAGAAGCACC AGGGAAAGTTTAG AGATTTGCGGCAAT GGACCGAAGAACG GGCCAGGAAGTCCT CCAATTTCCTTTGG TCTTT (SEQ ID NO: 1687) | CCGCAAATCTCTA AACTTTCCCTGGT GCTTCTTGTGGAA TTCACATGGCT (SEQ ID NO: 1688) | AAAGACCAAAG GAAATTGGAGG ACTTCCTGGCCC GTTCTTCGGTCC ATTG (SEQ ID NO: 1689) |
| RGS9 | NM_003835.1 | GGATCACCGATGAC ACCCAGTTCTGGGA CTTAAATGCCAAAT TGGTGGAAATCCCA ACCAAGATGCGAG TGGAACGATGGGC CTTCAACTTCAGCG AATT (SEQ ID NO: 1690) | TTCCACCAATTTG GCATTTAAGTCCC AGAACTGGGTGT CATCGGTGATCC (SEQ ID NO: 1691) | AATTCGCTGAAG TTGAAGGCCCAT CGTTCCACTCGC ATCTTGGTTGGG AT (SEQ ID NO: 1692) |
| RHCE | NM_020485.4 | GACAACTTCCTCTC ACTGTTGCCTGCAT TTGTACGTGAGAAA CGCTCATGACAGCA AAGTCTCCTTATGT ATAATGAAACAAG GTCAGAGACAGATT TGA (SEQ ID NO: 1693) | CATGAGCGTTTCT CACGTACAAATG CAGGCAACAGTG AGAGGAAGTTGT C (SEQ ID NO: 1694) | TCAAATCTGTCT CTGACCTTGTTT CATTATACATAA GGAGACTTTGCT GT (SEQ ID NO: 1695) |
| RHEBL1 | NM_144593.1 | GAAGACATCTTTGG CACATCAATTTGTG | AGCCTTCCGAGA ACTCGCCTTCCAC | TTTGCCAAGAGT CACTATCTTGCT |

TABLE 1-continued

| Gene | GenBank Accession No. | Target Sequence | Capture Probe Sequence | Reporter Probe Sequence |
|---|---|---|---|---|
| | | GAAGGCGAGTTCTC GGAAGGCTACGAT CCTACAGTGGAGA ATACTTACAGCAAG ATAGTGACTCTTGG CAAA (SEQ ID NO: 1696) | AAATTGATGTGC CAAAGATGTCTTC (SEQ ID NO: 1697) | GTAAGTATTCTC CACTGTAGGATC GT (SEQ ID NO: 1698) |
| RHOF | NM_019034.2 | CTGCGGCAAGACCT CGCTGCTCATGGTG TACAGCCAGGGCTC CTTCCCCGAGCACT ACGCCCATCGGTG TTCGAGAAGTACAC GGCCAGCGTGACC GTT (SEQ ID NO: 1699) | CGGGGAAGGAGC CCTGGCTGTACAC CATGAGCAGCGA G (SEQ ID NO: 1700) | TGGCCGTGTACT TCTCGAACACCG ATGGGGCGTAGT GCT (SEQ ID NO: 1701) |
| RHOXF1 | NM_139282.1 | CGCCAATGAACTAC GTGCTGACCCAGAC GACTGTGTCTACAT CGTCGTGGACTAGC CCTAGAATGCCATC CTTCTTCAGGAGCT AGTTTGGAGATGGG TT (SEQ ID NO: 1702) | CCACGACGATGT AGACACAGTCGT CTGGGTCAGCAC GTAGTTCAT (SEQ ID NO: 1703) | AACCCATCTCCA AACTAGCTCCTG AAGAAGGATGG CATTCTAGGGCT AGT (SEQ ID NO: 1704) |
| RNASEH2B | NM_001142279.1 | CAGTTCCCGGGTAC AGTCAACTGCATTT TTCTCTGGTGACCA AGCTTCCACTGACA AGGAAGAGGATTA TATTCGTTATGCCC ATGGTCTGATATCT GAC (SEQ ID NO: 1705) | TGGAAGCTTGGT CACCAGAGAAAA ATGCAGTTGACT GTACCCGGGAAC TG (SEQ ID NO: 1706) | GTCAGATATCAG ACCATGGGCATA ACGAATATAATC CTCTTCCTTGTC AG (SEQ ID NO: 1707) |
| RNF214 | NM_207343.2 | AAGCTTGGATTTCC GACCTGTAGTGTCT CCAGCAAATGGGG TTGAAGGAGTCCGA GTGGATCAGGATG ATGATCAAGATAGC TCTTCCCTGAAGCT TTCT (SEQ ID NO: 1708) | CTCCTTCAACCCC ATTTGCTGGAGA CACTACAGGTCG GAAATCCAAGCT T (SEQ ID NO: 1709) | AGAAAGCTTCAG GGAAGAGCTATC TTGATCATCATC CTGATCCACTCG GA (SEQ ID NO: 1710) |
| RNGTT | NM_003800.3 | CCTTTTTGGTG GAG AAAATGGATTGGA GTATCGAAGCAGC AGTTGCTACTTTTG CCCAAGCCAGACC ACCAGGAATCTACA AGGGTGATTATTTG AAGGA (SEQ ID NO: 1711) | AGTAGCAACTGC TGCTTCGATACTC CAATCCATTTTCT CCACCAAAAAGG (SEQ ID NO: 1712) | TCCTTCAAATAA TCACCCTTGTAG ATTCCTGGTGGT CTGGCTTGGGCA AA (SEQ ID NO: 1713) |
| ROBO1 | NM_002941.2 | TGAACCACAAAAA AAAAGGCTGGTGTT CACCAAAACCAAA CTTGTTCATTTAGA TAATTTGAAAAAGT TCCATAGAAAAGG CGTGCAGTACTAAG GGAAC (SEQ ID NO: 1714) | AATGAACAAGTT TGGTTTTGGTGAA CACCAGCCTTTTT TTTTGTGGTTCA (SEQ ID NO: 1715) | GTTCCCTTAGTA CTGCACGCCTTT TCTATGGAACTT TTTCAAATTATC TA (SEQ ID NO: 1716) |
| ROBO4 | NM_019055.5 | CCTGACTCTCAGAT CTCTTCCCAGAGAA GTCAGCTCCACTGT CGTATGCCCAAGGC TGGTGCTTCTCCTG TAGATTACTCCTGA ACCGTGTCCCTGAG AC (SEQ ID NO: 1717) | GGCATACGACAG TGGAGCTGACTTC TCTGGGAAGAGA TCTGAGAG (SEQ ID NO: 1718) | CAGGGACACGGT TCAGGAGTAATC TACAGGAGAAG CACCAGCCTTG (SEQ ID NO: 1719) |

TABLE 1-continued

| Gene | GenBank Accession No. | Target Sequence | Capture Probe Sequence | Reporter Probe Sequence |
|---|---|---|---|---|
| RPN2 | NM_001135771.1 | AGATGCCACTTTGA AGAACCCAATCCTC TGGAATGTGGCTGA TGTGGTCATCAAGT TCCCTGAGGAAGA AGCTCCCTCGACTG TCTTGTCCCAGAAC CTT (SEQ ID NO: 1720) | TGACCACATCAG CCACATTCCAGA GGATTGGGTTCTT CAAAGTGGCATC T (SEQ ID NO: 1721) | AAGGTTCTGGGA CAAGACAGTCGA GGGAGCTTCTTC CTCAGGGAACTT GA (SEQ ID NO: 1722) |
| RPS6KA5 | NM_004755.2 | GTGGAACTATTGAA TACATGGCACCAGA TATTGTCAGAGGGG GAGATTCAGGACAT GACAAGGCAGTTG ACTGGTGGAGTTTG GGTGTTCTAATGTA TGA (SEQ ID NO: 1723) | TGAATCTCCCCCT CTGACAATATCTG GTGCCATGTATTC AATAGTTCCAC (SEQ ID NO: 1725) | TCATACATTAGA ACACCCAAACTC CACCAGTCAACT GCCTTGTCATGT 1724) |
| RRP1B | NM_015056.2 | CAACAGGAAGCGC CTCTCCAAACTCAT CAAGAAATTCCAA GACCTTTCTGAAGG AAGCAGTATATCTC AACTCAGTTTTGCG GAGGACATTTCTGC TGAT (SEQ ID NO: 1726) | CAGAAAGGTCTT GGAATTTCTTGAT GAGTTTGGAGAG GCGCTTCCTGTTG (SEQ ID NO: 1727) | ATCAGCAGAAAT GTCCTCCGCAAA ACTGAGTTGAGA TATACTGCTTCC TT (SEQ ID NO: 1728) |
| RSAD2 | NM_080657.4 | AGGAAGCTGGTAT GGAGAAGATCAAC TTTTCAGGTGGAGA GCCATTTCTTCAAG ACCGGGGAGAATA CCTGGGCAAGTTGG TGAGGTTCTGCAAA GTAGA (SEQ ID NO: 1729) | AAGAAATGGCTC TCCACCTGAAAA GTTGATCTTCTCC ATACCAGCTTCCT (SEQ ID NO: 1730) | TCTACTTTGCAG AACCTCACCAAC TTGCCCAGGTAT TCTCCCCGGTCT TG (SEQ ID NO: 1731) |
| RTCD1 | NM_001130841.1 | AGCGTGGCTGTGTG ACTAAGATATATGG AAGAGCTTTCGTTG CTGGTGTTTTGCCA TTTAAAGTAGCAAA AGATATGGCAGCG GCAGCAGTTAGATG CAT (SEQ ID NO: 1732) | AACACCAGCAAC GAAAGCTCTTCC ATATATCTTAGTC ACACAGCCACGC T (SEQ ID NO: 1733) | ATGCATCTAACT GCTGCCGCTGCC ATATCTTTTGCT ACTTTAAATGGC AA (SEQ ID NO: 1734) |
| RUNDC2B | XM_001714307.1 | CCTGCGTGCCCGGG CCTGTCCCTCCTGA CCCCAGGATTATAG TGGCGAGGCAGGG TGTTAGCCAAGCGG ATTGAGCCAGGAC ACAGCACCGCGGA GCCCT (SEQ ID NO: 1735) | CCTCGCCACTATA ATCCTGGGGTCA GGAGGGACAGGC (SEQ ID NO: 1736) | TGCTGTGTCCTG GCTCAATCCGCT TGGCTAACACCC TG (SEQ ID NO: 1737) |
| RXRA | NM_002957.4 | TACAAATGTAATTT TATCCCTCATGTAT ACTTGGATATGGCG GGGGAGGGCTGG GACTGTTTCGTTTC TGCTTCTAGAGATT GAGGTGAAAGCTTC GTC (SEQ ID NO: 1738) | CCTCCCCCCGCCA TATCCAAGTATAC ATGAGGGATAAA ATTACATTTGTA (SEQ ID NO: 1739) | GACGAAGCTTTC ACCTCAATCTCT AGAAGCAGAAA CGAAACAGTCCC AGC (SEQ ID NO: 1740) |
| S100Z | NM_130772.3 | GGGGTCTGCCTGGA ATAGCACTGAATGT | CAAGCCAAAGGC ACTACTAAACAC | ACCTAATTTATG AGCATGGGAAG |

TABLE 1-continued

| Gene | GenBank Accession No. | Target Sequence | Capture Probe Sequence | Reporter Probe Sequence |
|---|---|---|---|---|
| | | GTTTAGTAGTGCCTTTGGCTTGGGGGCTTTGGAGAAAGCTGCTTGAGCCCTTCCCATGCTCATAAATTAGGT (SEQ ID NO: 1741) | ATTCAGTGCTATTCCAGGCAGACCCC (SEQ ID NO: 1742) | GGCTCAAGCAGCTTTCTCCAAAGCCCC (SEQ ID NO: 1743) |
| S1PR2 | NM_004230.2 | TCCCGCCAGGTGGCCTCGGCCTTCATCGTCATCCTCTUFTGCGCCATTGTGGTGGAAAACCTTCTGGTGCTCATTGCGGTGGCCCGAAACAGCAAGTTCC (SEQ ID NO: 1744) | ACAATGGCGCAACAGAGGATGACGATGAAGGCCGAGGCCACCTGG (SEQ ID NO: 1745) | GGAACTTGCTGTTTCGGGCCACCGCAATGAGCACCAGAAGGTTTTCCACC (SEQ ID NO: 1746) |
| SAA1 | NM_199161.1 | AGCTTCTTTTCGTTCCTTGGCGAGGCTTTTGATGGGGCTCGGGACATGTGGAGAGCCTACTCTGACATGAGAGAAGCCAATTACATCGGCTCAGACAAAT (SEQ ID NO: 1747) | CACATGTCCCGAGCCCCATCAAAAGCCTCGCCAAGGAACGAAAAGAAGCT (SEQ ID NO: 1748) | ATTTGTCTGAGCCGATGTAATTGGCTTCTCTCATGTCAGAGTAGGCTCTC (SEQ ID NO: 1749) |
| SACS | NM_014363.4 | TTGAGTCTTTTAGGGCAGATGCAGACACAGTGCTGCTCTTTCTGAAAAGTGTGCAGGATGTTTCCTTATATGTCCGAGAGGCTGACGGAACAGAGAAACT (SEQ ID NO: 1750) | ACTTTTCAGAAAGAGCAGCACTGTGTCTGCATCTGCCCTAAAAGACTCAA (SEQ ID NO: 1751) | TTTCTCTGTTCCGTCAGCCTCTCGGACATATAAGGAAACATCCTGCAC (SEQ ID NO: 1752) |
| SAE1 | NM_005500.2 | CTACCAGTTGCCTTTTCAGACCTGAGGCTCTAACTCAAGAGATTCCTCCTCTCCCTCACCATTCCTGCCACCATTTTTTCTGGGTGATGCAGCAAGAGTT (SEQ ID NO: 1753) | AGGAGGAATCTCTTGAGTTAGAGCCTCAGGTCTGAAAAGGCAACTGGTAG (SEQ ID NO: 1754) | AACTCTTGCTGCATCACCCAGAAAAAATGGTGGCAGGAATGGTGAGGGAG (SEQ ID NO: 1755) |
| SAMSN1 | NM_022136.3 | ATTCAGGACCATTCTGTGGCCGTGCCAGAGTGCATACGGATTTCACGCCAAGTCCCTATGACACTGACTCCCTCAAAATCAAGAAGGAGACATCATAGA (SEQ ID NO: 1756) | TGGCGTGAAATCCGTATGCACTGGGCACGGCCACAGAATGGTCCTGAAT (SEQ ID NO: 1757) | TCTATGATGTCTCCTTTCTTGATTTTGAGGGAGTCAGTGTCATAGGGACT (SEQ ID NO: 1758) |
| SAP30 | NM_003864.3 | ACAAGTAAATACACTTAGGAGATACAAAAGACACTTCAAGCTACCAACCAGACCAGGACTTAATAAAGCACAACTTGTTGAGATAGTTGGTTGCCACTTT (SEQ ID NO: 1759) | TGGTTGGTAGCTTGAAGTGTCTTTTGTATCTCCTAAGTGTATTTACTTGT (SEQ ID NO: 1760) | AAAGTGGCAACCAACTATCTCAACAAGTTGTGCTTTATTAAGTCCTGGTC (SEQ ID NO: 1761) |
| SCARA5 | NM_173833.4 | CAGCCTTACCTCCAGGTAGCACTTAATTGGTCCATTCACCTAGACTGCAAGTAAGAAGACAAAATGACTGAGACCGTGTGCCCACCTGAACTTATTGTCT (SEQ ID NO: 1762) | TTGCAGTCTAGGTGAATGGACCAATTAAGTGCTACCTGGAGGTAAGGCTG (SEQ ID NO: 1763) | AGACAATAAGTTCAGGTGGGCACACGGTCTCAGTCATTTTGTCTTCTTAC (SEQ ID NO: 1764) |

TABLE 1-continued

| Gene | GenBank Accession No. | Target Sequence | Capture Probe Sequence | Reporter Probe Sequence |
|---|---|---|---|---|
| SDC1 | NM_002997.4 | TGAAATTCTCCTGG AGGTCGGTAGGTTC AGCCAAGGTTTTAT AAGGCTGATGTCAA TTTCTGTGTTGCCA AGCTCCAAGCCCCA TCTTCTAAATGGCA AA (SEQ ID NO: 1765) | TCAGCCTTATAAA ACCTTGGCTGAA CCTACCGACCTCC AGGAGAATTTCA (SEQ ID NO: 1766) | TTTGCCATTTAG AAGATGGGGCTT GGAGCTTGGCAA CACAGAAATTGA CA (SEQ ID NO: 1767) |
| SDCCAG8 | NM_006642.2 | CCGGAAACATGCA CAATTCTTGGATTA CAACAGGTGAAGA TTCTGGGGTGGGCG AAACCTCCAAAAG ACCATTTTCCCATG ACAATGCAGATTTT GGCAA (SEQ ID NO: 1768) | CACCCCAGAATC TTCACCTGTTGTA ATCCAAGAATTG TGCATGTTTCCGG (SEQ ID NO: 1769) | TTGCCAAAATCT GCATTGTCATGG GAAAATGGTCTT TTGGAGGTTTCG CC (SEQ ID NO: 1770) |
| SEL1L3 | NM_015187.3 | TACTCCATTATTGC AAGGCCAACCTCTG TGGGATTCTGTACT TTGTTGACTCTAAT GAGATGTACGGCA CACCTTCTGTATTT CTTACGGAAGAGG GCTA (SEQ ID NO: 1771) | GTCAACAAAGTA CAGAATCCCACA GAGGTTGGCCTT GCAATAATGGAG TA (SEQ ID NO: 1772) | TAGCCCTCTTCC GTAAGAAATACA GAAGGTGTGCCG TACATCTCATTA GA (SEQ ID NO: 1773) |
| SEMA7A | NM_001146029.1 | CCCACAGTTCATCA AGCCACCATCGTG CACCAAGACCAGG CTTACGATGACAAG ATCTACTACTTCTT CCGAGAGGACAAT CCTGACAAGAATCC TGAG (SEQ ID NO: 1774) | CATCGTAAGCCT GGTCTTGGTGCAC GATGGTGGCTTTG ATGAACTG (SEQ ID NO: 1775) | TCAGGATTCTTG TCAGGATTGTCC TCTCGGAAGAAG TAGTAGATCTTG T (SEQ ID NO: 1776) |
| SEPHS1 | NM_001195602.1 | TGCCCATCTTCGTG AGAGAAAAAGCAG CACATCCTGCCCAT TTCTGGTGCTTTCT GCTCACAGGCACCA AAGCTGCACATGTA AACTGACTTCTTGC CAA (SEQ ID NO: 1777) | GCACCAGAAATG GGCAGGATGTGC TGCTTTTTCTCTC ACGAAGATGG (SEQ ID NO: 1778) | TTGGCAAGAAGT CAGTTTACATGT GCAGCTTTGGTG CCTGTGAGCAGA AA (SEQ ID NO: 1779) |
| SERBP1 | NM_001018068.1 | CCAAAGGGCGCTG GTTGGTAGGGTGAG GTGGGGGAGTATTT TAATTTTTGGAATT TGGGAAGCAGACA GCTTTACTTTGTAA GGTTGGAACAGCA GCACT (SEQ ID NO: 1780) | CAAAAATTAAAA TACTCCCCCACCT CACCCTACCAAC CAGCGCCCTTTGG (SEQ ID NO: 1781) | AGTGCTGCTGTT CCAACCTTACAA AGTAAAGCTGTC TGCTTCCCAAAT TC (SEQ ID NO: 1782) |
| SERPINA9 | NM_001042518.1 | CCACTAAATCCTAG GTGGGAAATGGCCT GTTAACTGATGGCA CATTGCTAATGCAC AAGAAATAACAAA CCACATCCCTCTTT CTGTTCTGAGGGTG CAT (SEQ ID NO: 1783) | TAGCAATGTGCC ATCAGTTAACAG GCCATTTCCCACC TAGGATTTAG (SEQ ID NO: 1784) | ATGCACCCTCAG AACAGAAAGAG GGATGTGGTTTG TTATTTCTTGTGC AT (SEQ ID NO: 1785) |
| SERPINB1 | NM_030666.2 | TTACACTCTCAACT CCGACCTCGCCCGC | TAAAGAGATCCT GCACACCTAGGC | AAAAATATCTCT GGCTCCTGACAT |

TABLE 1-continued

| Gene | GenBank Accession No. | Target Sequence | Capture Probe Sequence | Reporter Probe Sequence |
|---|---|---|---|---|
| | | CTAGGTGTGCAGGA TCTCTTTAACAGTA GCAAGGCTGATCTG TCTGGCATGTCAGG AGCCAGAGATATTT TT (SEQ ID NO: 1786) | GGGCGAGGTCGG AGTTGAG (SEQ ID NO: 1787) | GCCAGACAGATC AGCCTTGCTACT GT (SEQ ID NO: 1788) |
| SFN | NM_006142.3 | TGGGCCTGGCCCTG AACTTTTCCGTCTT CCACTACGAGATCG CCAACAGCCCCGA GGAGGCCATCTCTC TGGCCAAGACCACT TTCGACGAGGCCAT GGC (SEQ ID NO: 1789) | GCTGTTGGCGATC TCGTAGTGGAAG ACGGAAAAGTTC AGGGCCAGGC (SEQ ID NO: 1790) | TCGAAAGTGGTC TTGGCCAGAGAG ATGGCCTCCTCG GG (SEQ ID NO: 1791) |
| SFPQ | NM_005066.2 | GGAGGTGGTGGTG GCATAGGTTATGAA GCTAATCCTGGCGT TCCACCAGCAACCA TGAGTGGTTCCATG ATGGGAAGTGACA TGCGTACTGAGCGC TTTG (SEQ ID NO: 1792) | GCTGGTGGAACG CCAGGATTAGCTT CATAACCTATGCC ACCACC (SEQ ID NO: 1793) | CAAAGCGCTCAG TACGCATGTCAC TTCCCATCATGG AACCACTCATGG TT (SEQ ID NO: 1794) |
| SGK1 | NM_005627.2 | GTGTGAACCGTCGT GTGAGTGTGGTATG CCTGATCACAGATG GATTTTGTTATAAG CATCAATGTGACAC TTGCAGGACACTAC AACGTGGGACATTG TT (SEQ ID NO: 1795) | ACAAAATCCATC TGTGATCAGGCA TACCACACTCAC ACGACGGTTCAC AC (SEQ ID NO: 1796) | AACAATGTCCCA CGTTGTAGTGTC CTGCAAGTGTCA CATTGATGCTTA TA (SEQ ID NO: 1797) |
| SGOL2 | NM_152524.5 | AGACCTCCATAGAT CCTTCTCCAGAGAG CCATGAAGTAATGG AAAGAATACTTGAC AGCGTTCAGGGAA AGTCTACTGTATCT GAACAAGCTGATA AGGA (SEQ ID NO: 1798) | TATTCTTTCCATT ACTTCATGGCTCT CTGGAGAAGGAT CTATGGAGGT (SEQ ID NO: 1799) | TCCTTATCAGCT TGTTCAGATACA GTAGACTTTCCC TGAACGCTGTCA AG (SEQ ID NO: 1800) |
| SH2D1A | NM_002351.4 | GCTGTATCACGGTT ACATTTATACATAC CGAGTGTCCCAGAC AGAAACAGGTTCTT GGAGTGCTGAGAC AGCACCTGGGGTAC ATAAAAGATATTTC CGG (SEQ ID NO: 1801) | CTGTTTCTGTCTG GGACACTCGGTA TGTATAAATGTA ACCGTGATACAG C (SEQ ID NO: 1802) | CCGGAAATATCT TTTATGTACCCC AGGTGCTGTCTC AGCACTCCAAGA AC (SEQ ID NO: 1803) |
| SH3BP5 | NM_001018009.2 | AGCTCTTGGGCTGG TTTTTCAGAGCAGA GTTCTTGTTGTGGG TAGACTGTGACTTG GTTCACAGCCTTTG TGGAACATTCCGTA TAACGGCATTGTGG AA (SEQ ID NO: 1804) | ACAGTCTACCCA CAACAAGAACTC TGCTCTGAAAAA CCAGCCCAAGAG CT (SEQ ID NO: 1805) | TTCCACAATGCC GTTATACGGAAT GTTCCACAAAGG CTGTGAACCTAG TC (SEQ ID NO: 1806) |
| SIDT1 | M4017699.2 | GGTCATCATGGTCA CCGTCCTTGGAGTG GTGTTTGGAAAAAA TGACGTATGGTTCT GGGTCATCTTCTCT GCAATCCACGTTCT GGCCTCGCTAGCCC TC (SEQ ID NO: 1807) | ATACGTCATTTTT TCCAAACACCAC TCCAAGGACGGT GACCATGATGAC C (SEQ ID NO: 1808) | GGCTAGCGAGGC CAGAACGTGGAT TGCAGAGAAGAT GACCCAGAACC (SEQ ID NO: 1809) |
| SIRPA | NM_080792.2 | CCAGGGCAAGCAG ATGTCGCAAGCCCT | GTTATAGTGAAG ACTGAATAAATA | GCATCCCAAGGC CAGGAGTCATGA |

TABLE 1-continued

| Gene | GenBank Accession No. | Target Sequence | Capture Probe Sequence | Reporter Probe Sequence |
|---|---|---|---|---|
| | | ATTTATTCAGTCTT CACTATAACTCTTA GAGTTGAGACGCTA ATGTTCATGACTCC TGGCCTTGGGATGC CCA (SEQ ID NO: 1810) | GGGCTTGCGACA TCTGCTTGCCCTG G (SEQ ID NO: 1811) | ACATTAGCGTCT CAACTCTAAGA (SEQ ID NO: 1812) |
| SIRPB1 | NM_006065.2 | ACAATTGGTTTTCA GGGCCCAGTCCAA GCCTGCTGCTGGAA ACCTCAGAGTTAAA TCCCTATTCTCCAC ACCTCTCACCTCCA CCACCCCTCCCTGT CCC (SEQ ID NO: 1813) | CTCTGAGGTTTCC AGCAGCAGGCTT GGACTGGGCCCT GAAAACCAATTG T (SEQ ID NO: 1814) | GACAGGGAGGG GTGGTGGAGGTG AGAGGTGTGGA GAATAGGGATTT AA (SEQ ID NO: 1815) |
| SLA | NM_001045556.2 | GTGTGATTTCTGAT GAAGGGGGCTGGT GGAAAGCTATTTCT CTTAGCACTGGTCG AGAGAGTTACATCC CTGGAATATGTGTG GCCAGAGTTTACCA TGG (SEQ ID NO: 1816) | AGTGCTAAGAGA AATAGCTTTCCAC CAGCCCCCTTCAT CAGAAATCACAC (SEQ ID NO: 1817) | CCATGGTAAACT CTGGCCACACAT ATTCCAGGGATG TAACTCTCTGA CC (SEQ ID NO: 1818) |
| SLAMF1 | NM_003037.2 | GTGTCTCTTGATCC ATCCGAAGCAGGC CCTCCACGTTATCT AGGAGATCGCTAC AAGTTTTATCTGGA GAATCTCACCCTGG GGATACGGGAAAG CAGGA (SEQ ID NO: 1819) | CGATCTCCTAGAT AACGTGGAGGGC CTGCTTCGGATGG ATCAAGAGACAC (SEQ ID NO: 1820) | TCCTGCTTTCCC GTATCCCCAGGG TGAGATTCTCCA GATAAAACTTGT AG (SEQ ID NO: 1821) |
| SLC12A8 | NM_024628.5 | GAACAACACGCTG CCCGATTACAGCCC GGGGAATCTTTTT TCACTGTCTTTGGG GTTTTCTTCCCAGC GGCTACAGGAGTC ATGGCCGGCTTCAA CATG (SEQ ID NO: 1822) | AGACAGTGAAAA AAGATTCCCCCG GGCTGTAATCGG GCAGCGTGTTGTT C (SEQ ID NO: 1823) | CATGTTGAAGCC GGCCATGACTCC TGTAGCCGCTGG GAAGAAAACCC CAA (SEQ ID NO: 1824) |
| SLC16A9 | NM_194298.2 | TTACCTCACTGAAG TACTCGCATGTTGT TTGGTACCCACTGA GCAACTGTTTCAGT TCCTAAGGTATTTG CTGAGATGTGGGTG AACTCCAAATGGA GAA (SEQ ID NO: 1825) | ACAGTTGCTCAGT GGGTACCAAACA ACATGCGAGTAC TTCAGTGAGGTA A (SEQ ID NO: 1826) | TTCTCCATTTGG AGTTCACCCACA TCTCAGCAAATA CCTTAGGAACTG AA (SEQ ID NO: 1827) |
| SLC1A4 | NM_003038.4 | TTTTTCCAATTACC TGCTGACACGGTTC TAAGCTAAGTGAA GGGGAAGATCTGA GAGCGTGCTGTTTG TGGCTGTTGATGCA TATTCGTGATGTAA CAGG (SEQ ID NO: 1828) | ATCTTCCCCTTCA CTTAGCTTAGAAC CGTGTCAGCAGG TAATTGGAAAAA (SEQ ID NO: 1829) | CCTGTTACATCA CGAATATGCATC AACAGCCACAA ACAGCACGCTCT CAG (SEQ ID NO: 1830) |
| SLC31A1 | NM_001859.3 | TTGACATCAAACTC TATGGCGTGGCCTT ATCGATTGCAGTGG GAAGTTGTTGAAGA CTTGAAGACGTGAT TCCTGCTCCAATCA TCCCTTCTTGCTCCT C (SEQ ID NO: 1831) | ACAACTTCCCACT GCAATCGATAAG GCCACGCCATAG AGTTTGATGTCAA (SEQ ID NO: 1832) | GAGGAGCAAGA AGGGATGATTGG AGCAGGAATCAC GTCTTCAAGTCT TCA (SEQ ID NO: 1833) |

TABLE 1-continued

| Gene | GenBank Accession No. | Target Sequence | Capture Probe Sequence | Reporter Probe Sequence |
|---|---|---|---|---|
| SLC35E2B | NM_001110781.1 | CGGTGACTTTCAGCGTCGCCAGCACCGTGAAACATGCCTTGTCCATCTGGCTCAGCGTAATCGTTTTCGGCAACAAGATCACCAGCTTGTCGGCCGTTGG (SEQ ID NO: 1834) | CCAGATGGACAAGGCATGTTTCACGGTGCTGGCGACGCTGAAAGTCACCG (SEQ ID NO: 1835) | CCAACGGCCGACAAGCTGGTGATCTTGTTGCCGAAAACGATTACGCTGAG (SEQ ID NO: 1836) |
| SLC38A5 | NM_033518.2 | ACGACATGTGGCCATAGCTCTGATCCTGCTTGTTTTGGTCAATGTCCTTGTCATCTGTGTGCCAACCATCCGGGATATCTTTGGAGTTATCGGGTCCACC (SEQ ID NO: 1837) | CAAGGACATTGACCAAAACAAGCAGGATCAGAGCTATGGCCACATGTCGT (SEQ ID NO: 1838) | GGTGGACCCGATAACTCCAAAGATATCCCGGATGGTTGGCACACAGATGA (SEQ ID NO: 1839) |
| SMAD1 | NM_005900.2 | CCTTGCATGTACTTGAAGGATGGATGAGTCAGACACGATTGAGAACTGACAAAGGAGCCTTGATAATACTTGACCTCTGTGACCAACTGTTGGATTCAGA (SEQ ID NO: 1840) | GTCAGTTCTCAATCGTGTCTGACTCATCCATCCTTCAAGTACATG (SEQ ID NO: 1841) | TCTGAATCCAACAGTTGGTCACAGAGGTCAAGTATTATCAAGGCTCCTTT (SEQ ID NO: 1842) |
| SMAD7 | NM_005904.2 | AGCAGAAATCCAAGCACCACCAAACACAGTGTATGAAGGGGGGCGGTCATCATTTCACTTGTCAGGAGTGTGTGTGAGTGTGAGTGTGCGGCTGTGTGTG (SEQ ID NO: 1843) | ATGACCGCCCCCCTTCATACACTGTGTTTGGTGGTGCTTGGATTTCTG (SEQ ID NO: 1844) | CACACACAGCCGCACACTCACACTCACACACACTCCTGACAAGTGAAATG (SEQ ID NO: 1845) |
| SMARCA4 | NM_003072.3 | GCCCTGTCCTGGCATCAGTAGCATCTGTAACAGCATTAACTGTCTTAAAGAGAGAGAGAGAATTCCGAATTGGGGAACACACGATACCTGTTTTTCTT (SEQ ID NO: 1846) | CTTTAAGACAGTTAATGCTGTTACAGATGCTACTGATGCCAGGACAGGGC (SEQ ID NO: 1847) | AAGAAAAACAGGTATCGTGTGTTCCCCAATTCGGAATTCTCTCTCTCT (SEQ ID NO: 1848) |
| SNAP23 | NM_003825.2 | GTTGAGGGAAGGACAAGAGATAAGAGGTTGTTACCTCAGTAAAAAACCTTCAGGCCACAAAGCAAAAAGTTGCATAGCCACAACGAAGATCTAGTTGGATA (SEQ ID NO: 1849) | GAAGGTTTTTACTGAGGTAACAACCTCTTATCTCTTGTCCTTCCCTCAAC (SEQ ID NO: 1850) | CAACTAGATCTTCGTTGTGGCTATGCAACTTTTTGCTTTGTGGCCT (SEQ ID NO: 1851) |
| SNN | NM_003498.4 | GGCAGGGGTCTCTCATGTGTGTCCATCTGCGTGTATGTCAAGGAAGTGAGATGCCAATTTGGGGTCTTGAGGCTGACCAGTTGGGGTGCTTGGGTGATCT (SEQ ID NO: 1852) | CTCACTTCCTTGACATACACGCAGATGGACACACATGAGAGACCCCTGC (SEQ ID NO: 1853) | CAAGCACCCCAACTGGTCAGCCTCAAGACCCCAAATTGGCAT (SEQ ID NO: 1854) |
| SNX11 | NM_152244.1 | TGGGAGGAGATCATGCTGTGCCTTTGG | AACTGTTTCTAACTGACCAGGGTCC | CGCATCTTCTCTGACCATCTCAGA |

TABLE 1-continued

| Gene | GenBank Accession No. | Target Sequence | Capture Probe Sequence | Reporter Probe Sequence |
|---|---|---|---|---|
| | | ACCCTGGTCAGTTA GAAACAGTTTTGGA AAAGTGAGCTCTGG GTTCTGCTCTGAGA TGGTCAGAGAAGA TGCG (SEQ ID NO: 1855) | AAAGGCACAGCA TGATCTCCTCC (SEQ ID NO: 1856) | GCAGAACCCAG AGCTCACTTTTC CAA (SEQ ID NO: 1857) |
| SNX22 | NM_024798.2 | AGGACTTAATTACC CAGTGCCCAGTTGT GCCACATTCCCACT CAAGGCTCAGAACT TGGCTCGCATTGGT AGCTGGAGGTGGT AGAATTTGTATGCT CTT (SEQ ID NO: 1858) | GAGCCTTGAGTG GGAATGTGGCAC AACTGGGCACTG GGTAATTAAGT (SEQ ID NO: 1859) | AAGAGCATACA AATTCTACCACC TCCAGCTACCAA TGCGAGCCAAGT TCT (SEQ ID NO: 1860) |
| SNX29 | NM_001080530.2 | ACTGCATTTTCCAC CAACAGTCATTAGA CACCTGGCACTGTC ACAGCTCACTTTTC CAGAGGGATATTCC TGTGGCTTTGGCAA GGAGCCATTAGTGA TG (SEQ ID NO: 1861) | TGAGCTGTGACA GTGCCAGGTGTCT AATGACTGTTGGT GGAAAATGCAGT (SEQ ID NO: 1862) | CATCACTAATGG CTCCTTGCCAAA GCCACAGGAATA TCCCTCTGGAAA AG (SEQ ID NO: 1863) |
| SOCS1 | NM_003745.1 | TTAACTGTATCTGG AGCCAGGACCTGA ACTCGCACCTCCTA CCTCTTCATGTTTA CATATACCCAGTAT CTTTGCACAAACCA GGGGTTGGGGGAG GGTC (SEQ ID NO: 1864) | ATGAAGAGGTAG GAGGTGCGAGTT CAGGTCCTGGC (SEQ ID NO: 1865) | GACCCTCCCCCA ACCCCTGGTTTG TGCAAAGATACT GGGTATATGTAA AC (SEQ ID NO: 1866) |
| SOCS2 | NM_003877.3 | GGAACGGCACTGTT CACCTTTATCTGAC CAAACCGCTCTACA CGTCAGCACCATCT CTGCAGCATCTCTG TAGGCTCACCATTA ACAAATGTACCGGT GC (SEQ ID NO: 1867) | TGCTGACGTGTA GAGCGGTTTGGT CAGATAAAGGTG AACAGTGCCGTT CC (SEQ ID NO: 1868) | GCACCGGTACAT TTGTTAATGGTG AGCCTACAGAGA TGCTGCAGAGAT GG (SEQ ID NO: 1869) |
| SOCS3 | NM_003955.3 | GGAGGATGGAGGA GACGGGACATCTTT CACCTCAGGCTCCT GGTAGAGAAGACA GGGGATTCTACTCT GTGCCTCCTGACTA TGTCTGGCTAAGAG ATTC (SEQ ID NO: 1870) | TTCTCTACCAGGA GCCTGAGGTGAA AGATGTCCCGTC (SEQ ID NO: 1871) | ACATAGTCAGGA GGCACAGAGTA GAATCCCCTGTC (SEQ ID NO: 1872) |
| SORBS1 | NM_001034956.1 | CCTCTCTTAGATCC TGAGTGAGACAAA TACAGAAATGACCC ATTCCCTGCCCACC AGAAACTCAGAGG TGATTGGGAGACT GACACAGGAAAAT GAACT (SEQ ID NO: 1873) | GCAGGGAATGGG TCATTTCTGTATT TGTCTCACTCAGG ATCTAAGAGAGG (SEQ ID NO: 1874) | TTCATFTTCCTGT GTCAGTCTCCCC AATCACCTCTGA GTTTCTGGTGG (SEQ ID NO: 1875) |
| SOX11 | NM_003108.3 | CTAAGCATTGACAG AATATCTTAAAATG GTAACCTGGGGTG GCGGGTGGGTGCTG TGTGCACGGCAGCC TAGCCAGTGGGGAT CCTGCTGTTTATTA TA (SEQ ID NO: 1876) | CCACCCGCCACC CCCAGGTTACCAT TTTAAGATATTCT GTCAATGCTTAG (SEQ ID NO: 1877) | TATAATAAACAG CAGGATCCCCAC TGGCTAGGCTGC CGTGCACACAGC AC (SEQ ID NO: 1878) |

TABLE 1-continued

| Gene | GenBank Accession No. | Target Sequence | Capture Probe Sequence | Reporter Probe Sequence |
|---|---|---|---|---|
| SOX5 | NM_152989.2 | TAGCCATGCAATGATGGATTTCAATCTGAGTGGAGATTCTGATGGAAGTGCTGGAGTCTCAGAGTCAAGAATTTATAGGGAATCCCGAGGGCGTGGTAGC (SEQ ID NO: 1879) | CACTTCCATCAGAATCTCCACTCAGATTGAAATCCATCATTGCATGGCTA (SEQ ID NO: 1880) | TACCACGCCCTCGGGATTCCCTATAAATTCTTGACTCTGAGACTCCAG (SEQ ID NO: 1881) |
| SPAG5 | NM_006461.3 | AACAAGACATGATATTTGAGGCCCGTTTAGATACCATGGCAGAGACAAACAGCATATCTTTAAATGGACCTTTGAGAACAGACGATCTGGTGAGAGAGGA (SEQ ID NO: 1882) | GTTTGTCTCTGCCATGGTATCTAAACGGGCCTCAAATATCATGTCTTGTT (SEQ ID NO: 1883) | TCCTCTCTCACCAGATCGTCTGTTCTCAAAGGTCCATTTAAAGATATGCT (SEQ ID NO: 1884) |
| SPARC | NM_003118.2 | TTTTCGAGACCTGTGACCTGGACAATGACAAGTACATCGCCCTGGATGAGTGGGCCGGCTGCTTCGGCATCAAGCAGAAGGATATCGACAAGGATCTTGT (SEQ ID NO: 1885) | CTCATCCAGGGCGATGTACTTGTCATTGTCCAGGTCACAGGTCTCGAAAA (SEQ ID NO: 1886) | CGATATCCTTCTGCTTGATGCCGAAGCAGCCGGCCCA (SEQ ID NO: 1887) |
| SPARCL1 | NM_004684.4 | TTGACCAACACCCTATGGATAGAGTCTTGACACATTCTGAACTTGCTCCTCTGCGAGCATCTCTGGTGCCCATGGAACACTGCATAACCCGTTTCTTTGA (SEQ ID NO: 1888) | AGGAGCAAGTTCAGAATGTGTCAAGACTCTATCCATAGGGTGTTGGTCA (SEQ ID NO: 1889) | TCAAAGAAACGGGTTATGCAGTGTTCCATGGGCACCAGAGATGCTCGCAG (SEQ ID NO: 1890) |
| SPATA6 | NM_019073.2 | GTCCAAACCAAATGTCTGGACACCATGATTCAAACCGCCAGGTTACCATGAGGAGGATTTCTGGCCTTCGAGGAAATGCTCCAAGGCTGGAATTTTCTAC (SEQ ID NO: 1891) | CATGGTAACCTGGCGGTTTGAATCATGGTGTCCAGACATTTGGTTTGGAC (SEQ ID NO: 1892) | GTAGAAAATTCCAGCCTTGGAGCATTTCCTCGAAGGCCAGAAATCCTCCT (SEQ ID NO: 1893) |
| SPATS1 | NM_145026.3 | CCACTTGAGCCTCTTCCACAAATTCCCAACTTGCCTTTCTGGGTGAAGGAGAAGGCCAACAGTTTGAAAAATGAGATACAAGAGGTTGAGGAGCTTGACA (SEQ ID NO: 1894) | TCCTTCACCCAGAAAGGCAAGTTGGGAATTTGTGGAAGAGGCTCAAGTG (SEQ ID NO: 1895) | TCAAGCTCCTCAACCTCTTGTATCTCATTTTTCAAACTGTTGGCCTTC (SEQ ID NO: 1896) |
| SPIB | NM_003121.3 | CTTTGTCATGTACAGACTCCCTGGGATCCTCATGTTTTGGGTGACAGGACCTATGGACCACTATACTCGGGGAGGCAGGGTAGCAGTTCTTCCAGAATCC (SEQ ID NO: 1897) | GTCCTGTCACCCAAAACATGAGGATCCCAGGGAGTCTGTACATGACAAAG (SEQ ID NO: 1898) | AAGAACTGCTACCCTGCCTCCCCGAGTATAGTGGTCCATAG (SEQ ID NO: 1899) |
| SPINK2 | NM_021114.2 | CCTGGCAGTCACCTTCGCAGCCTCTCTG | AAAACAGACCAAATTGAGGGATCA | GGGACATCCTGGTAATCTATACTG |

TABLE 1-continued

| Gene | GenBank Accession No. | Target Sequence | Capture Probe Sequence | Reporter Probe Sequence |
|---|---|---|---|---|
| | | ATCCCTCAATTTGG TCTGTTTTCAAAAT ATAGAACGCCAAA CTGCTCTCAGTATA GATTACCAGGATGT CCC (SEQ ID NO: 1900) | GAGAGGCTGCGA AGGTGACTGCCA GG (SEQ ID NO: 1901) | AGAGCAGTTTGG CGTTCTATATTTT G (SEQ ID NO: 1902) |
| SPINT2 | NM_021102.2 | CAGATGCCGGGCCT CCATGCCTAGGTGG TGGTACAATGTCAC TGACGGATCCTGCC AGCTGTTTGTGTAT GGGGGCTGTGACG GAAACAGCAATAA TTAC (SEQ ID NO: 1903) | ATCCGTCAGTGA CATTGTACCACCA CCTAGGCATGGA GGC (SEQ ID NO: 1904) | GTAATTATTGCT GTTTCCGTCACA GCCCCCATACAC AAACAGCTGGCA GG (SEQ ID NO: 1905) |
| SPON1 | NM_0061082 | GATTCCACATTTGA TGGGGTGACTGACA AACCCATCTTAGAC TGCTGTGCCTGCGG AACTGCCAAGTACA GACTCACATTTTAT GGGAATTGGTCCGA GA (SEQ ID NO: 1906) | GCACAG CAGTCT AAGATGGGTTTG TCAGTCACCCCAT CAAATGTGGAAT C (SEQ ID NO: 1907) | TCTCGGACCAAT TCCCATAAAATG TGAGTCTGTACT TGGCAGTTCCGC AG (SEQ ID NO: 1908) |
| SPRED2 | NM_181784.2 | TGTCGCTAGCAAGC ATCTGGTTCAGCGG AAATGGGATGTGA GAATGATGAAACC CGACAGAAGTATCT CAGCCTGCAGTCAG TTATTATGTATAGG AGGT (SEQ ID NO: 1909) | TCATCATTCTCAC ATCCCATTTCCG TGAACCAGATGC TTGCTAGCGACA (SEQ ID NO: 1910) | ACCTCCTATACA TAATAACTGCT GCAGGCTGAGAT ACTTCTGTCGGG TT (SEQ ID NO: 1911) |
| SPRY1 | NM_005841.1 | GGATGACTTGAAG GGTTCCTTGAAAGA GGACCTGACACAG CACAAGTTCATTTG TGAACAGTGTGGG AAGTGCAAGTGTG GAGAATGCACTGCT CCCAGG (SEQ ID NO: 1912) | TGAACTTGTGCTG TGTCAGGTCCTCT TTCAAGGAACCC TTCAAGTCATCC (SEQ ID NO: 1913) | CTGGGAGCAGTG CATTCTCCACAC TTGCACTTCCCA CACTGTTCACAA A (SEQ ID NO: 1914) |
| SRPK1 | NM_003137.3 | GGGCCTTTTTGAGG TTCTAGTGGAGAAG TATGAGTGGTCGCA GGAAGAGGCAGCT GGCTTCACAGATTT CTTACTGCCCATGT TGGAGCTGATCCCT GAG (SEQ ID NO: 1915) | CCTCTTCCTGCGA CCACTCATACTTC TCCACTAGAACCT CAAAAAGGCCC (SEQ ID NO: 1916) | CAGGGATCAGCT CCAACATGGGCA GTAAGAAATCTG TGAAGCCAGCTG (SEQ ID NO: 1917) |
| SRPX | NM_006307.2 | GTATGGTGCTAGTG GATAAGCATGGCAT GGACAAAGAGCGC TATGTCTCCCTGGT GATGCCTGTGGCCC TGTTCAACCTGATT GACACTTTTCCCTT GAG (SEQ ID NO: 1918) | GGAGACATAGCG CTCTTTGTCCATG CCATGCTTATCCA CTAG (SEQ ID NO: 1919) | CTCAAGGGAAA AGTGTCAATCAG GTTGAACAGGGC CACAGGCATCAC CAG (SEQ ID NO: 1920) |
| SRSF1 | NM_006924.4 | GAGAGGGCTCACT GGATCCCAATCCTT GGAGCTGGATCATT GGATTCAAATCATA ATGTGGATAGGATA GGGAGGATGAATT ACCAGGATTCATGG AGCG (SEQ ID NO: 1921) | TTTGAATCCAATG ATCCAGCTCCAA GGATTGGGATCC AGTGAGCCCTCT (SEQ ID NO: 1922) | CGCTCCATGAAT CCTGGTAATTCA TCCTCCCTATCC TATCCACATTAT GA (SEQ ID NO: 1923) |

TABLE 1-continued

| Gene | GenBank Accession No. | Target Sequence | Capture Probe Sequence | Reporter Probe Sequence |
|---|---|---|---|---|
| SSBP2 | NM_012446.2 | GGATCCAACTCGACAACAAGGACATCCAAATATGGGTGGGCCAATGCAGAGAATGACTCCTCCAAGAGGAATGGTGCCCTTAGGACCACAGAACTATGGA (SEQ ID NO: 1924) | TCTGCATTGGCCCACCCATATTTGGATGTCCTTGTTGTCGAGTTGGATCC (SEQ ID NO: 1925) | TGGTCCTAAGGGCACCATTCCTCTTGGAGGAGTCATTC (SEQ ID NO: 1926) |
| SSPN | NM_005086.4 | TCTCCTCTAAACCACGAAAGAGTAAGATTTGTGCAACCCTCCTCCTCTTCCACCTCCTTCAGGAGAATTAAATGAATCAAGACTTTGGAAAGACGGGGAA (SEQ ID NO: 1927) | GAAGAGGAGGAGGGTTGCACAAATCTTACTCTTTCGTGGTTTAGAGGAA (SEQ ID NO: 1928) | TTCCCCGTCTTTCCAAAGTCTTGATTCATTTAATTCTCCTGAAGGAGGTG (SEQ ID NO: 1929) |
| STAG3 | NM_012447.2 | AGGGACTCAAACCATACCTCAGAGGGGAATGGCGACTCTTTGTTAGCTGATGAAGACACTGACTTTGAAGACAGCTTGAATCGCAATGTGAAGAAGAGAG (SEQ ID NO: 1930) | TCAGCTAACAAAGAGTCGCCATTCCCCTCTGAGGTATGGTTTGAG (SEQ ID NO: 1931) | CTCTTCTTCACATTGCGATTCAGACTGTCTTCAAAGTCAGTGTCTTCA (SEQ ID NO: 1932) |
| STAMBPL1 | NM_020799.2 | ATGCTGGCATGCTTGAGGTTTCTGCTTGTAAAAAAAAGGGCTTTCATCCACACACCAAGGAGCCCAGGCTGTTCAGTATATGCAAACATGTGTTGGTAAA (SEQ ID NO: 1933) | TGGATGAAAGCCCTTTTTTTTACAAGCAGAAACCTCAAGCATGCCAGCAT (SEQ ID NO: 1934) | TTTACCAACACATGTTTGCATATACTGAACAGCCTGGGCTCCTTGGTGTG (SEQ ID NO: 1935) |
| STAP1 | NM_012108.2 | GAACCCTTCTTTGGGAAATATGATCCTGAGGCCTGGTAGTGACAGTAGAAACTACTCCATCACTATTCGGCAGGAGATAGACATTCCAAGAATCAAGCAC (SEQ ID NO: 1936) | TTCTACTGTCACTACCAGGCCTCAGGATCATATTTCCCAAAGAAGGGTTC (SEQ ID NO: 1937) | GTGCTTGATTCTTGGAATGTCTATCTCCTGCCGAATAGTGATGGAGTAGT (SEQ ID NO: 1938) |
| STAT1 | NM_007315.2 | TTTGCTGTATGCCATCCTCGAGAGCTGTCTAGGTTAACGTTCGCACTCTGTGTATATAACCTCGACAGTCTTGGCACCTAACGTGCTGTGCGTAGCTGCT (SEQ ID NO: 1939) | CAGAGTGCGAACGTTAACCTAGACAGCTCTCGAGGATGGCATACAGCAAA (SEQ ID NO: 1940) | AGCAGCTACGCACAGCACGTTAGGTGCCAAGACTGTCGAGGTTATATACA (SEQ ID NO: 1941) |
| STAT3 | NM_139276.2 | AGACTTGGGCTTACCATTGGGTTTAAATCATAGGGACCTAGGGCGAGGGTTCAGGGCTTCTCTGGAGCAGATATTGTCAAGTTCATGGCCTTAGGTAGCA (SEQ ID NO: 1942) | ACCCTCGCCCTAGGTCCCTATGATTTAAACCCAATGGTAAGCCCAAG (SEQ ID NO: 1943) | TGCTACCTAAGGCCATGAACTTGACAATATCTGCTCCAGAGAAGCCCTGA (SEQ ID NO: 1944) |
| STEAP1 | NM_012449.2 | GATGCCTGGATTGAGCATGATGTTTGGA | AGAGACACATAAATCTCCATTCTCC | GAATAGATGTCACAGCCAACAGA |

TABLE 1-continued

| Gene | GenBank Accession No. | Target Sequence | Capture Probe Sequence | Reporter Probe Sequence |
|---|---|---|---|---|
| | | GAATGGAGATTTAT GTGTCTCTGGGAAT TGTGGGATTGGCAA TACTGGCTCTGTTG GCTGTGACATCTAT TC (SEQ ID NO: 1945) | AAACATCATGCT CAATCCAGGCAT C (SEQ ID NO: 1946) | GCCAGTATTGCC AATCCCACAATT CCC (SEQ ID NO: 1947) |
| STK17A | NM_004760.1 | CTTTCAGGATGGAA AAGGCACTAGAAG AAGCAAATGCCCTC CAAGAAGGTCATTC TGTGCCTGAAATTA ATTCGGATACCGAC AAATCAGAAACCG AGGA (SEQ ID NO: 1948) | ACCTTCTTGGAGG GCATTTGCTTCTT CTAGTGCCTTTTC CATCCTGAAAG (SEQ ID NO: 1949) | TCCTCGGTTTCT GATTTGTCGGTA TCCGAATTAATT TCAGGCACAGAA TG (SEQ ID NO: 1950) |
| STK38L | NM_015000.1 | CCAGACTTGGCTTG GATGACTTTGAGTC TCTGAAAGTTATAG GAAGAGGAGCTTTT GGAGAGGTGCGGT TGGTCCAGAAGAA AGATACAGGCCAT ATCTA (SEQ ID NO: 1951) | TCCTCTTCCTATA ACTTTCAGAGACT CAAAGTCATCCA AGCCAAGTCTGG (SEQ ID NO: 1952) | TAGATATGGCCT GTATCTTTCTTCT GGACCAACCGCA CCTCTCCAAAAG C (SEQ ID NO: 1953) |
| STMN1 | NM_203401.1 | CGTGGGTGGCGGC AGGACTTTCCTTAT CCCAGTTGATTGTG CAGAATACACTGCC TGTCGCTTGTCTTC TATTCACCATGGCT TCTTCTGATATCCA GGT (SEQ ID NO: 1954) | TGTATTCTGCACA ATCAACTGGGAT AAGGAAAGTCCT GCCGCCACCCAC G (SEQ ID NO: 1955) | ACCTGGATATCA GAAGAAGCCAT GGTGAATAGAA GACAAGCGACA GGCAG (SEQ ID NO: 1956) |
| STS | NM_000351.4 | GACCCAGCTGTAGT GAGGTTGCAGTGAT TGAGTAGGATTGGC CTGCTTCAAAGCAG AGGTTTCTCATGGG AATATGCTTATTAA ACTCCCACTGGTGC AG (SEQ ID NO: 1957) | TGAAGCAGGCCA ATCCTACTCAATC ACTGCAACCTCA CTACAGCTGG (SEQ ID NO: 1958) | CTGCACCAGTGG GAGTTTAATAAG CATATTCCCATG AGAAACCTCTGC TT (SEQ ID NO: 1959) |
| STX11 | NM_003764.3 | TGACACCTTGCACT CTTACCGTCTTGAC AGAAGCCAAGTAA GGAACTGAAGTTGT ATCTGACTGTAGGG TGAATGTCTGAGGC CTGCCTCCTAATAA AGA (SEQ ID NO: 1960) | TTCAGTTCCTTAC TTGGCTTCTGTCA AGACGGTAAGAG TGCAAGGTG (SEQ ID NO: 1961) | TTTATTAGGAGG CAGGCCTCAGAC ATTCACCCTACA GTCAGATACAAC (SEQ ID NO: 1962) |
| SUFU | NM_016169.2 | GGTGCCTCTTCCTG CCCGTATCTTTCTC TTCCAAGGGCAGTG CTCCAAGGCAGGG ACTGGAGAAGCCA AGGGGAGAGTCTA AAAGGGCTAGAGC ATTTTT (SEQ ID NO: 1963) | CCTTGGAGCACT GCCCTTGGAAGA GAAAGATACGGG CAGGAAGAGGCA CC (SEQ ID NO: 1964) | AAAAATGCTCTA GCCCTTTTAGAC TCTCCCCTTGGC TTCTCCAGTCCC TG (SEQ ID NO: 1965) |
| SULF1 | NM_015170.2 | TCCAGAAATCAGG AGACGGAGACATTT TGTCAGTTTTGCAA CATTGGACCAAATA CAATGAAGTATTCT TGCTGTGCTCTGGT TTTGGCTGTCCTGG GCA (SEQ ID NO: 1966) | GGTCCAATGTTGC AAAACTGACAAA ATGTCTCCGTCTC CTGATTTCTGGA (SEQ ID NO: 1967) | TGCCCAGGACAG CCAAAACCAGA GCACAGCAAGA ATACTTCATTGT ATTT (SEQ ID NO: 1968) |

TABLE 1-continued

| Gene | GenBank Accession No. | Target Sequence | Capture Probe Sequence | Reporter Probe Sequence |
|---|---|---|---|---|
| SUN5 | NM_080675.3 | GATGGAAGCCATGT CCGATGAGCAAAA AATGGCCCAGAAA ATAATGAAGATGAT ACACGGAGATTAC ATCGAAAAGCCAG ACTTTGCCCTGAAG TCTATA (SEQ ID NO: 1969) | TCTTCATTATTTT CTGGGCCATTTTT TGCTCATCGGAC ATGGCTT (SEQ ID NO: 1970) | TATAGACTTCAG GGCAAAGTCTGG CTTTTCGATGTA ATCTCCGTGTAT CA (SEQ ID NO: 1971) |
| SYCP1 | NM_003176.2 | GCATTGTTCGTACC ACCGAGATCAAGC AGCAGTCAGGTGTC TGCGGTGAAACCTC AGACCCTGGGAGG CGATTCCACTTTCT TCAAGAGTTTCAAC AAAT (SEQ ID NO: 1972) | TTCACCGCAGAC ACCTGACTGCTGC TTGATCTCGGTGG TACGAACAATG (SEQ ID NO: 1973) | ATTTGTTGAAAC TCTTGAAGAAAG TGGAATCGCCTC CCAGGGTCTGAG GT (SEQ ID NO: 1974) |
| SYK | NM_003177.3 | CGGACTCTCCAAAG CACTGCGTGCTGAT GAAAACTACTACA AGGCCCAGACCCAT GGAAAGTGGCCTGT CAAGTGGTACGCTC CGGAATGCATCAAC TAC (SEQ ID NO: 1975) | TCTGGGCCTTGTA GTAGTTTTCATCA GCACGCAGTGCT TTGGAGAGTCCG (SEQ ID NO: 1976) | GTAGTTGATGCA TTCCGGAGCGTA CCACTTGACAGG CCACTTTCCATG GG (SEQ ID NO: 1977) |
| SYPL1 | NM_182715.1 | GGTCCTCGAGTGGA TTGCTTCTATCTTTG CTTTTGCCACCTGT GGAGGTTTTAAGGG CCAAACAGAAATTC AAGTGAATTGTCCT CCTGCAGTTACTGA G (SEQ ID NO: 1978) | AACCTCCACAGG TGGCAAAAGCAA AGATAGAAGCAA TCCACTCGAGGA CC (SEQ ID NO: 1979) | CTCAGTAACTGC AGGAGGACAATT CACTTGAATTTC TGTTTGGCCCTT AA (SEQ ID NO: 1980) |
| SYT17 | NM_016524.2 | CTGCTCCTGACCGT GGTGGATTTTGATA AGTTCTCCCGCCAC TGTGTCATTGGGAA AGTTTCTGTGCCTT TGTGTGAAGTTGAC CTGGTCAAGGGCG GGC (SEQ ID NO: 1981) | ATGACACAGTGG CGGGAGAACTTA TCAAAATCCACC ACGGTCAGGAGC AG (SEQ ID NO: 1982) | CCGCCCTTGACC AGGTCAACTTCA CACAAAGGCAC AGAAACTTTCCC A (SEQ ID NO: 1983) |
| SYTL4 | NM_001129896.1 | GCCGGAGCTGGGTT GCGATCTTCCCGGA GCCGGAGACCCTCC CTTGAAACCGGCAC TGGGACTTCTCGAT CTCTGGAGGCACCT GTTGCAAGTGACAG AG (SEQ ID NO: 1984) | GTTTCAAGGGAG GGTCTCCGGCTCC GGGAAGATCGCA AC (SEQ ID NO: 1985) | CAACAGGTGCCT CCAGAGATCGAG AAGTCCCAGTGC CG (SEQ ID NO: 1986) |
| TARS | NM_152295.3 | CCCTCGCCAGGTAA TGGTAGTTCCAGTG GGACCAACCTGTGA TGAATATGCCCAAA AGGTACGACAACA ATTCCACGATGCCA AATTCATGGCAGAC ATT (SEQ ID NO: 1987) | CATATTCATCACA GGTTGGTCCCACT GGAACTACCATT ACCTGGCG (SEQ ID NO: 1988) | AATGTCTGCCAT GAATTTGGCATC GTGGAATTGTTG TCGTACCTTTTG GG (SEQ ID NO: 1989) |
| TAX1BP1 | NM_006024.4 | AAAAAACCACACC TAAAATAGACCACT | AGCATCCGCTCTA TGGTCTCCTCAGT | CCAAACTCAAAG TAGCTCCTGGTC |

TABLE 1-continued

| Gene | GenBank Accession No. | Target Sequence | Capture Probe Sequence | Reporter Probe Sequence |
|---|---|---|---|---|
| | | GAGGAGACCATAG AGCGGATGCTTTCA TGCACCCTTTACTG CACTTTCTGACCAG GAGCTACTTTGAGT TTGG (SEQ ID NO: 1990) | GGTCTATTTTAGG TGTGGTTTTTT (SEQ ID NO: 1991) | AGAAAGTGCAGT AAAGGGTGCATG AA (SEQ ID NO: 1992) |
| TBC1D27 | XM_002343481.2 | TGAGCTGCATTTTT TGGAGAGGCGGCC CCTGTCCCCAAAGC TGGTGCAAGCCCTG GGTGTAGCAGGCC AGTGCCTTGCAGTG CAATTGTACCTGAG GACC (SEQ ID NO: 1993) | CTTGCACCAGCTT TGGGGACAGGGG CCGCCTCTCCAAA AAATGCAG (SEQ ID NO: 1994) | TACAATTGCACT GCAAGGCACTGG CCTGCTACACCC AGGG (SEQ ID NO: 1995) |
| TBC1D9 | NM_015130.2 | ACCAATAAAGACA GCACACTGCCTCCC ATTCCTCACCTCCA CTCCTTGCTCAGCG ATGATGTGGAACCT TACCCTGAGGTAGA CATCTTTAGACTCA TCA (SEQ ID NO: 1996) | AGCAAGGAGTGG AGGTGAGGAATG GGAGGCAGTGTG CTGTCTTTATTG (SEQ ID NO: 1997) | TGATGAGTCTAA AGATGTCTACCT CAGGGTAAGGTT CCACATCATCGC TG (SEQ ID NO: 1998) |
| TCF3 | NM_003200.2 | ATACGTGTCAACAC AGCTGGCTGGATGA TTGGGACTTTAAAA CGACCCTCTTTCAG GTGGATTCAGAGAC CTGTCCTGTATATA ACAGCACTGTAGCA AT (SEQ ID NO: 1999) | GAGGGTCGTTTTA AAGTCCCAATCA TCCAGCCAGCTGT GTTGACACGTAT (SEQ ID NO: 2000) | ATTGCTACAGTG CTGTTATATACA GGACAGGTCTCT GAATCCACCTGA AA (SEQ ID NO: 2001) |
| TCF4 | NM_001083962.1 | TTAGGGGAAGCTCG GCTGCCCTAGTAAC AAAACCAGCAAAC GTCCTGATGACAAC GAAGTGATGACATT AGCCATTCCTTAGG GTAGGAGGAACAG ATGG (SEQ ID NO: 2002) | CATCAGGACGTTT GCTGGTYTTGTTA CTAGGGCAGCCG AGCTTCCCCTAA (SEQ ID NO: 2003) | CCATCTGTTCCT CCTACCCTAAGG AATGGCTAATGT CATCACTTCGTT GT (SEQ ID NO: 2004) |
| TCTN3 | NM_015631.5 | AGGTATTGTGGGCA TATGTAGGTCTCCT GTCCAACCCGCAAG CTCATGTATCAGGA GTTCGATTCCTATA CCAGTGCCAGTCTA TACAGGATTCTCAG CA (SEQ ID NO: 2005) | TACATGAGCTTGC GGGTTGGACAGG AGACCTACATAT GCCCACAATACC T (SEQ ID NO: 2006) | TGCTGAGAATCC TGTATAGACTGG CACTGGTATAGG AATCGAACTCCT GA (SEQ ID NO: 2007) |
| TEAD1 | NM_021961.5 | CCAGAAGAGGGCT AAGATACGTTTTCT GTCTTGAGCTGAAA GCACAGTCTACTCT CCTTCGTTTTGTCG ATGAGAAAGTTGA GGCCAGAGGGGAG GTGAC (SEQ ID NO: 2008) | AGACTGTGCTTTC AGCTCAAGACAG AAAACGTATCTT AGCCCTCTTCTGG (SEQ ID NO: 2009) | TCACCTCCCCTC TGGCCTCAACTT TCTCATCGACAA AACGAAGGAGA GT (SEQ ID NO: 2010) |
| TEK | NM_000459.2 | CGAGTTCGAGGAG AGGCAATCAGGAT ACGAACCATGAAG ATGCGTCAACAAGC TTCCTTCCTACCAG CTACTTTAACTATG ACTGTGGACAAGG AGAGATA (SEQ ID NO: 2011) | TGTTGACGCATCT TCATGGTTCGTAT CCTGATTGCCTCT CCTCGAACTCG (SEQ ID NO: 2012) | TATCTCCCTTGT CCACAGTCATAG TTAAAGTAGCTG GTAGGAAGGAA GCT (SEQ ID NO: 2013) |

TABLE 1-continued

| Gene | GenBank Accession No. | Target Sequence | Capture Probe Sequence | Reporter Probe Sequence |
|---|---|---|---|---|
| TERT | NM_198253.1 | GGCTTCAAGGCTGG GAGGAACATGCGT CGCAAACTCTTTGG GGTCTTGCGGCTGA AGTGTCACAGCCTG TTTCTGGATTTGCA GGTGAACAGCCTCC AGA (SEQ ID NO: 2014) | CGCAAGACCCCA AAGAGTTTGCGA CGCATGTTCCTCC CAGCCTTGAAGC C (SEQ ID NO: 2015) | TCTGGAGGCTGT TCACCTGCAAAT CCAGAAACAGG CTGTGACACTTC AGC (SEQ ID NO: 2016) |
| TEX9 | NM_198524.1 | ACCTGGACCCGACC TCCTCGCCTTGGAG GAAGAATATAAGC GTTTAAATGCAGAA TTGCAGGCAAAAA CAGCTGACGTGGTT CAACAAGCTAAGG AAATA (SEQ ID NO: 2017) | CATTTAAACGCTT ATATTCTTCCTCC AAGGCGAGGAGG TCGGGTCCAG (SEQ ID NO: 2018) | TATTTCCTTAGC TTGTTGAACCAC GTCAGCTGTTTT TGCCTGCAATTC TG (SEQ ID NO: 2019) |
| TFDP2 | NM_006286.3 | GACCTTCTTGGTTA AATCAGGGACTACT TCTGAACTCTACCC AATCAGTTTCAAAT TTAGACCTGACCAC TGGTGCCACCTTAC CCCAGTCAAGTGTA AA (SEQ ID NO: 2020) | AACTGATTGGGT AGAGTTCAGAAG TAGTCCCTGATTT AACCAAGAAGGT C (SEQ ID NO: 2021) | TTTACACTTGAC TGGGGTAAGGTG GCACCAGTGGTC AGGTCTAAATTT GA (SEQ ID NO: 2022) |
| TFPI2 | NM_006528.2 | TTTAATCCAAGATA CAGAACCTGTGATG CTTTCACCTATACT GGCTGTGGAGGGA ATGACAATAACTTT GTTAGCAGGGAGG ATTGCAAACGTGCA TGTG (SEQ ID NO: 2023) | CCACAGCCAGTA TAGGTGAAAGCA TCACAGGTTCTGT ATCTTGGATTAAA (SEQ ID NO: 2024) | CACATGCACGTT TGCAATCCTCCC TGCTAACAAAGT TATTGTCATTCC CT (SEQ ID NO: 2025) |
| TGFBR1 | NM_004612.2 | GGGGAAATACGAC TTAGTGAGGCATAG ACATCCCTGGTCCA TCCTTTCTGTCTCC AGCTGTTTCTTGGA ACCTGCTCTCCTGC TTGCTGGTCCCTGA CGC (SEQ ID NO: 2026) | CAGAAAGGATGG ACCAGGGATGTC TATGCCTCACTAA GTCGTATTTCCCC (SEQ ID NO: 2027) | AGGGACCAGCA AGCAGGAGAGC AGGTTCCAAGAA ACAGCTGGAGA (SEQ ID NO: 2028) |
| THBS2 | NM_003247.2 | AAACATCCTTGCAA ATGGGTGTGACGCG GTTCCAGATGTGGA TTTGGCAAAACCTC ATTTAAGTAAAAGG TTAGCAGAGCAAA GTGCGGTGCTTTAG CTG (SEQ ID NO: 2029) | TTGCCAAATCCAC ATCTGGAACCGC GTCACACCCATTT GCAAGGATGTTT (SEQ ID NO: 2030) | CAGCTAAAGCAC CGCACTTTGCTC TGCTAACCTTTT ACTTAAATGAGG TT (SEQ ID NO: 2031) |
| THOC5 | NM_001002878.1 | CCTGGGGATCATGG AAAGAAAACTCCG AATCCAGCCAATCA GTATCAGTTTGATA AAGTTGGCATCCTG ACTTTGAGCGACTA TGTACTTGAGCTAG GTC (SEQ ID NO: 2032) | AACTGATACTGA TTGGCTGGATTCG GAGTTTTCTTTCC ATGATCCCCAGG (SEQ ID NO: 2033) | GACCTAGCTCAA GTACATAGTCGC TCAAAGTCAGGA TGCCAACTTTAT CA (SEQ ID NO: 2034) |
| THY1 | NM_006288.2 | CCTGCCTAGTGGAC CAGAGCCTTCGTCT | GGTATTCTCATGG CGGCAGTCCAGA | TTCTTTGTCTCAC GGGTCAGGCTGA |

TABLE 1-continued

| Gene | GenBank Accession No. | Target Sequence | Capture Probe Sequence | Reporter Probe Sequence |
|---|---|---|---|---|
| | | GGACTGCCGCCATG AGAATACCAGCAG TTCACCCATCCAGT ACGAGTTCAGCCTG ACCCGTGAGACAA AGAA (SEQ ID NO: 2035) | CGAAGGCTCT (SEQ ID NO: 2036) | ACTCGTACTGGA TGGGTGAACTGC T (SEQ ID NO: 2037) |
| TIAM2 | NM_001010927.2 | TTGCCTGGGGATGA GAGGGAGAGACAA CGTGTGTCTTACAC ATCTCCCAACAGCC GACTTAGATGTGAT CCGTTCTCCCAGAG GGAGCAGGTTTCTT TGA (SEQ ID NO: 2038) | TTGGGAGATGTG TAAGACACACGT TGTCTCTCCCTCT CATCC (SEQ ID NO: 2039) | TCAAAGAAACCT GCTCCCTCTGGG AGAACGGATCAC ATCAAGTCGGC TG (SEQ ID NO: 2040) |
| TICAM2 | NM_021649.4 | TATTCCCCACTTGT ATATCCCCTACCAG TACCGGGATCTGCA CACATCTTTTTGCA GTTACCTCTTCATA GCCATGAACCAAA ACGTTCTATGAGGA GCA (SEQ ID NO: 2041) | AAGATGTGTGCA GATCCCGGTACT GGTAGGGGATAT ACAAGTGGGGAA TA (SEQ ID NO: 2042) | TGCTCCTCATAG AACGTTTTGGTT CATGGCTATGAA GAGGTAACTGCA AA (SEQ ID NO: 2043) |
| TJP2 | NM_004817.2 | AGCCAATGATAGCT GGTTTGGCAGCTTA AAGGACACTATTCA GCATCAGCAAGGA GAAGCGGTTTGGGT CTCTGAAGGAAAG ATGGAAGGGATGG ATGAT (SEQ ID NO: 2044) | GCTGATGCTGAA TAGTGTCCTTTAA GCTGCCAAACCA GCTATCATTGGCT (SEQ ID NO: 2045) | ATCATCCATCCC TTCCATCTTTCCT TCAGAGACCCAA ACCGCTTCTCCT T (SEQ ID NO: 2046) |
| TK1 | NM_003258.1 | GGATGGCCTGGATT CACGCCCTCTTGTT TCCTTTTGGGCTCA AAGCCCTTCCTACC TCTGGTGATGGTTT CCACAGGAACAAC AGCATCTTTCACCA AGA (SEQ ID NO: 2047) | AAGGGCTTTGAG CCCAAAAGGAAA CAAGAGGGCGTG AATCCAGGCCAT CC (SEQ ID NO: 2048) | TCTTGGTGAAAG ATGCTGTTGTTC CTGTGGAAACCA TCACCAGAGGTA GG (SEQ ID NO: 2049) |
| TLE4 | NM_007005.3 | AAAACAAGGACAG CAGAGGAGGGTTT GCAGAGACCTCCCT CTGAAAAACACAA AGAATGGACTCTCT CCTGGGATGAGGA CTTGCTTTCTTTACC TCCGG (SEQ ID NO: 2050) | TGTTTTTCAGAGG GAGGTCTCTGCA AACCCTCCTCTGC TGTCCTTGTTTT (SEQ ID NO: 2051) | CCGGAGGTAAA GAAAGCAAGTCC TCATCCCAGGAG AGAGTCCATTCT TTG (SEQ ID NO: 2052) |
| TLK1 | NM_012290.3 | CCACGCGTCCGCGG GTTCCCAGAAAGTA GCTTGATGAGTGTC CAAAGTAGCAGTG GAAGTTTGGAGGG GCCGCCATCTTGGT CCCAGCTCTCCACG TCTC (SEQ ID NO: 2053) | CTACTTTGGACAC TCATCAAGCTACT TTCTGGGAACCC GCGGACGCGTGG (SEQ ID NO: 2054) | TGGGACCAAGAT GGCCGGCCCCTCC AAACTTCCACTG (SEQ ID NO: 2055) |
| TLR7 | NM_016562.3 | TGTGGGCACCACAC AGGTGGTTGCTGCT TCAGTGCTTCCTGC TCTTTTTCCTTGGG CCTGCTTCTGGGTT CCATAGGGAAACA GTAAGAAAGAAAG ACAC (SEQ ID NO: 2056) | GAAAAAGAGCAG GAAGCACTGAAG CAGCAACCACCT GTGTGGTGCCCA CA (SEQ ID NO: 2057) | GTGTCTTTCTTTC TTACTGTTTCCCT ATGGAACCCAGA AGCAGGCCCAA G (SEQ ID NO: 2058) |

TABLE 1-continued

| Gene | GenBank Accession No. | Target Sequence | Capture Probe Sequence | Reporter Probe Sequence |
|---|---|---|---|---|
| TM4SF1 | NM_014220.2 | AATCGCAGTATTTA AGAGGTAGCAGGA ATGGGCTGAGAGT GGTGTTTGCTTTCT CCACCAGAAGGGC ACACTTTCATCTAA TTTGGGGTATCACT GAGCT (SEQ ID NO: 2059) | AGCAAACACCAC TCTCAGCCCATTC CTGCTACCTCTTA AATACTGCGATT (SEQ ID NO: 2060) | AGCTCAGTGATA CCCCAAATTAGA TGAAAGTGTGCC CTTCTGGTGGAG AA (SEQ ID NO: 2061) |
| TMBIM6 | NM_003217.2 | GGCCCTTCCTTCCT CATTGTTGTTTGGT ATGCGCACAGTTCC TGTGGGACTGGGCC GTGAGTTTTCCATT GGAAAGAAGTTCA GTGGTCCCATTGTT AAC (SEQ ID NO: 2062) | GTCCCACAGGAA CTGTGCGCATACC AAACAACAATGA GGAAGGAAGGGC C (SEQ ID NO: 2063) | GTTAACAATGGG ACCACTGAACTT CTTTCCAATGGA AAACTCACGGCC CA (SEQ ID NO: 2064) |
| TMEM109 | NM_024092.2 | TAGGGGCCACTTTT CCTTTGAGGCTCTA GTGGAGGTGGATGT CCTTCTCTGCCAGG CTTGGCACATGATG TGAAGAATAAATG CCCAATTCTTACTG TTC (SEQ ID NO: 2065) | AGAGAAGGACAT CCACCTCCACTAG AGCCTCAAAGGA AAAGTGGCCCCT A (SEQ ID NO: 2066) | GAACAGTAAGA ATTGGGCATTTA TTCTTCACATCA TGTGCCAAGCCT GGC (SEQ ID NO: 2067) |
| TMEM119 | NM_181724.2 | GTCACAGGTCATTT GTGGGGCAAACAT CACTGCTTTTCCAT CAAGGGAGCAAAG AATAAGTGGGAGTT TTGGAAGAGTTTGG ATGAGAGACGCCA AGGTG (SEQ ID NO: 2068) | GCTCCCTTGATGG AAAAGCAGTGAT GTTTGCCCCACAA ATGACCTGTGAC (SEQ ID NO: 2069) | CACCTTGGCGTC TCTCATCCAAAC TCTTCCAAAACT CCCACTTATTCT TT (SEQ ID NO: 2070) |
| TMOD1 | NM_003275.2 | AGATGCTCAAGGA GAACAAGGTGTTG AAGACACTGAATGT GGAATCCAACTTCA TTTCTGGAGCTGGG ATTCTGCGCCTGGT AGAAGCCCTCCCAT ACAA (SEQ ID NO: 2071) | GTTGGATTCCACA TTCAGTGTCTTCA ACACCTTGTTCTC CTTGAGCATCT (SEQ ID NO: 2072) | TTGTATGGGAGG GCTTCTACCAGG CGCAGAATCCCA GCTCCAGAAATG AA (SEQ ID NO: 2073) |
| TMPRSS6 | NM_153609.2 | CCCGAGGGCCTAGT GATCCTGGAAGCCA GTGTGAAAGACAT AGCTGCATTGAATT CCACGCTGGGTTGT TACCGCTACAGCTA CGTGGGCCAGGGC CAGG (SEQ ID NO: 2074) | AATGCAGCTATG TCTTTCACACTGG CTTCCAGGATCAC TAGG (SEQ ID NO: 2075) | GCCCACGTAGCT GTAGCGGTAACA ACCCAGCGTGGA ATTC (SEQ ID NO: 2076) |
| TNF | NM_000594.2 | AGCAACAAGACCA CCACTTCGAAACCT GGGATTCAGGAAT GTGTGGCCTGCACA GTGAAGTGCTGGCA ACCACTAAGAATTC AAACTGGGGCCTCC AGAA (SEQ ID NO: 2077) | CAGGCCACACAT TCCTGAATCCCAG GTTTCGAAGTGGT GGTCTTGTTGCT (SEQ ID NO: 2078) | TTCTGGAGGCCC CAGTTTGAATTC TTAGTGGTTGCC AGCACTTCACTG TG (SEQ ID NO: 2079) |
| TNFAIP2 | NM_006291.2 | GTCACTGTACCCGG CCTGCTCTACCGCT | TGTGATCATAAG CGTCCTTAAAAG | CAGCTGACCTGA AAATAGAAAGA |

TABLE 1-continued

| Gene | GenBank Accession No. | Target Sequence | Capture Probe Sequence | Reporter Probe Sequence |
|---|---|---|---|---|
| | | TTTAAGGACGCTTA TGATCACATTGCGC CTACCCAGAGAACC CAGGTCGTCTTTCT ATTTTCAGGTCAGC TG (SEQ ID NO: 2080) | CGGTAGAGCAGG CCGGGTACAGTG AC (SEQ ID NO: 2081) | CGACCTGGGTTC TCTGGGTAGGCG CAA (SEQ ID NO: 2082) |
| TNFAIP3 | NM_006290.2 | CAAAGCCCTCATCG ACAGAAACATCCA GGCCACCCTGGAA AGCCAGAAGAAAC TCAACTGGTGTCGA GAAGTCCGGAAGC TTGTGGCGCTGAAA ACGAAC (SEQ ID NO: 2083) | TCTTCTGGCTTTC CAGGGTGGCCTG GATGTTTCTGTCG ATGAG (SEQ ID NO: 2084) | GTTCGTMCAG CGCCACAAGCTT CCGGACTTCTCG ACACCAGTTGAG TT (SEQ ID NO: 2085) |
| TNFRSF13B | NM_012452.2 | TGCAAAACCATTTG CAACCATCAGAGCC AGCGCACCTGTGCA GCCTTCTGCAGGTC ACTCAGCTGCCGCA AGGAGCAAGGCAA GTTCTATGACCATC TCC (SEQ ID NO: 2086) | CAGAAGGCTGCA CAGGTGCGCTGG CTCTGATGGTTGC AAATGGTTTTGCA (SEQ ID NO: 2087) | TCATAGAACTTG CCTTGCTCCTTG CGGCAGCTGAGT GACCTG (SEQ ID NO: 2088) |
| TNERSF14 | NM_003820.2 | CTCAGGGAGCCTCG TCATCGTCATTGTT TGCTCCACAGTTGG CCTAATCATATGTG TGAAAAGAAGAAA GCCAAGGGGTGAT GTAGTCAAGGTGAT CGTC (SEQ ID NO: 2089) | TGATTAGGCCAA CTGTGGAGCAAA CAATGACGATGA CGAGGCTCCCTG AG (SEQ ID NO: 2090) | GACGATCACCTT GACTACATCACC CCTTGGCTTTCTT CTTTTCACACAT A (SEQ ID NO: 2091) |
| TNFRSF17 | NM_001192.2 | TCTGACCATTGCTT TCCACTCCCAGCTA TGGAGGAAGGCGC AACCATTCTTGTCA CCACGAAAACGAA TGACTATTGCAAGA GCCTGCCAGCTGCT TTGA (SEQ ID NO: 2092) | AGAATGGTTGCG CCTTCCTCCATAG CTGGGAGTGGAA AGCAATGGT (SEQ ID NO: 2093) | TCAAAGCAGCTG GCAGGCTCTTGC AATAGTCATTCG TTTTCGTGGTGA CA (SEQ ID NO: 2094) |
| TNFRSF19 | NM_018647.2 | TGAATCAGGAGACT GTAGACAGCAAGA ATTCAGGGATCGGT CTGGAAACTGTGTT CCCTGCAACCAGTG TGGGCCAGGCATG GAGTTGTCTAAGGA ATGT (SEQ ID NO: 2095) | AGTTTCCAGACC GATCCCTGAATTC TTGCTGTCTACAG TCTCCTGATTCA (SEQ ID NO: 2096) | TTAGACAACTCC ATGCCTGGCCCA CACTGGTTGCAG GGAACAC (SEQ ID NO: 2097) |
| TNFSF10 | NM_003810.2 | GGGGGGACCCAGC CTGGGACAGACCTG CGTGCTGATCGTGA TCTTCACAGTGCTC CTGCAGTCTCTCTG TGTGGCTGTAACTT ACGTGTACTTTACC AAC (SEQ ID NO: 2098) | CTGTGAAGATCA CGATCAGCACGC AGGTCTGTCCC (SEQ ID NO: 2099) | GTTGGTAAAGTA CACGTAAGTTAC AGCCACACAGA GAGACTGCAGG AGCA (SEQ ID NO: 2100) |
| TNFSF4 | NM_003326.2 | GAAGGTCAGGTCTG TCAACTCCTTGATG GTGGCCTCTCTGAC TTACAAAGACAAA GTCTACTTGAATGT GACCACTGACAATA CCTCCCTGGATGAC TTC (SEQ ID NO: 2101) | CTTTGTAAGTCAG AGAGGCCACCAT CAAGGAGTTGAC AGACCTGACCTTC (SEQ ID NO: 2102) | GAAGTCATCCAG GGAGGTATTGTC AGTGGTCACATT CAAGTAGACTTT GT (SEQ ID NO: 2103) |

TABLE 1-continued

| Gene | GenBank Accession No. | Target Sequence | Capture Probe Sequence | Reporter Probe Sequence |
|---|---|---|---|---|
| TNXB | NM_019105.5 | CAGGTGGTACCTGT GGAAGGGCCCGAG CGTTCATTTGTTGT CTCCTCACTGGACC CTGACCACAAGTAC AGATTCACTCTGTT TGGAATTGCGAACA AGA (SEQ ID NO: 2104) | AGTGAGGAGACA ACAAATGAACGC TCGGGCCCTTCCA CAGGTACCACCT G (SEQ ID NO: 2105) | TCTTGTTCGCAA TTCCAAACAGAG TGAATCTGTACT TGTGGTCAGGGT CC (SEQ ID NO: 2106) |
| TOP2A | NM_001067.2 | TTTCAGCTCTTGAC CTGTCCCCTCTGGC TGCCTCTGAGTCTG AATCTCCCAAAGAG AGAAACCAATTTCT AAGAGGACTGGAT TGCAGAAGACTCG GGGA (SEQ ID NO: 2107) | GGGAGATTCAGA CTCAGAGGCAGC CAGAGGGGACA (SEQ ID NO: 2108) | TCCCCGAGTCTT CTGCAATCCAGT CCTCTTAGAAAT TGGTTTCTCTCTT T (SEQ ID NO: 2109) |
| TOX | NM_014729.2 | AATGAGCAGCTTTG ACTTTGACAGGCGG TTTGTGCAGGAAAG CACAGTGCCGTGTT GTTTACAGCTTTTC TAGAGCAGCTGTGC GACCAGGGTAGAG AGT (SEQ ID NO: 2110) | GCACTGTGCTTTC CTGCACAAACCG CCTGTCAAAGTC AAAGCTGC (SEQ ID NO: 2111) | ACTCTCTACCCT GGTCGCACAGCT GCTCTAGAAAAG CTGTAAACAACA CG (SEQ ID NO: 2112) |
| TP53 | NM_000546.2 | GGGGAGCAGGGCT CACTCCAGCCACCT GAAGTCCAAAAAG GGTCAGTCTACCTC CCGCCATAAAAAA CTCATGTTCAAGAC AGAAGGGCCTGAC TCAGAC (SEQ ID NO: 2113) | TAGACTGACCCTT TTTGGACTTCAGG TGGCTGGAGTGA GCCCTG (SEQ ID NO: 2114) | GTCTGAGTCAGG CCCTTCTGTCTT GAACATGAGTTT TTTATGGCGGGA GG (SEQ ID NO: 2115) |
| TP73 | NM_005427.1 | CAAGCCGGGGAA TAATGAGGTGGTGG GCGGAACGGATTCC AGCATGGACGTCTT CCACCTGGAGGGC ATGACTACATCTGT CATGGCCCAGTTCA ATCT (SEQ ID NO: 2116) | GTCCATGCTGGA ATCCGTTCCGCCC ACCACCTCATTAT T (SEQ ID NO: 2117) | CATGACAGATGT AGTCATGCCCTC CAGGTGGAAGA C (SEQ ID NO: 2118) |
| TPM1 | NM_000366.5 | CCTCTCTGAGCTCT GCATTTGTCTATTC TCCAGCTGACCCTG GTTCTCTCTCTTAG CATCCTGCCTTAGA GCCAGGCACACACT GTGCTTTCTATTGT AC (SEQ ID NO: 2119) | GAGAGAACCAGG GTCAGCTGGAGA ATAGACAAATGC AGAGCTCAGAGA GG (SEQ ID NO: 2120) | GTACAATAGAAA GCACAGTGTGTG CCTGGCTCTAAG GCAGGATGCTAA GA (SEQ ID NO: 2121) |
| TPX2 | NM_012112.4 | TGGGACCTGCTCTT AACCTCAAACCTAG GACCGTCTTGCTTT GTCATTGGGCATGG AGAGAACCCATTTC TCCAGACTTTTACC TACCCGTGCCTGAG AA (SEQ ID NO: 2122) | CCAATGACAAAG CAAGACGGTCCT AGGTTTGAGGTT AAGAGCAGGTCC CA (SEQ ID NO: 2123) | TTCTCAGGCACG GGTAGGTAAAA GTCTGGAGAAAT GGGTTCTCTCCA TGC (SEQ ID NO: 2124) |
| TRAF1 | NM_005658.3 | CGAGTGATGGGTCT AGGCCCTGAAACTG | CAAGAGGTTATT GCTAGGACATCA | TTGTTCTACAAA TCCCCCCTTGGG |

TABLE 1-continued

| Gene | GenBank Accession No. | Target Sequence | Capture Probe Sequence | Reporter Probe Sequence |
|---|---|---|---|---|
| | | ATGTCCTAGCAATAACCTCTTGATCCCTACTCACCGAGTGTTGAGCCCAAGGGGGGATTTGTAGAACAAGCC (SEQ ID NO: 2125) | GTTTCAGGGCCTAGACCCATCACTCG (SEQ ID NO: 2126) | CTCAACACTCGGTGAGTAGGGAT (SEQ ID NO: 2127) |
| TRAF3 | NM_145725.1 | ATATGATGCCCTGCTTCCTTGGCCGTTTAAGCAGAAAGTGACACTCATGCTGATGGATCAGGGGTCCTCTCGACGTCATTTGGGAGATGCATTCAAGCCC (SEQ ID NO: 2128) | GCATGAGTGTCACTTTCTGCTTAAACGGCCAAGGAAGCAGGGCATCATAT (SEQ ID NO: 2129) | GCTTGAATGCATCTCCCAAATGACGTCGAGAGGACCCCTGATCCATCA (SEQ ID NO: 2130) |
| TRIM56 | NM_030961.1 | GTGGAGGCCGAGGACATTTTCCTGAAGGGCAGGGGTTGGCAACTTTTCAACATGGAGTGCCAAACTGCTAACCCGTCTTCTAGTGTGTGAGAATAGGGAC (SEQ ID NO: 2131) | TTGAAAAGTTGCCAACCCCTGCCCTTCAGGAAAATGTCCTCGGCCT (SEQ ID NO: 2132) | CCTATTCTCACACACTAGAAGACGGGTTAGCAGTTTGGCACTCCATG (SEQ ID NO: 2133) |
| TRIM6-TRIM34 | NM_001003819.3 | AAGGATGCTGCGAGTGTGTAGAGAGCTGACAGATGTCCAAAGCTACTGGGCCATCCAGGGGTCTTTAACCAGAAGAGAGAGGAGAGCCTCAGGAGTTAGG (SEQ ID NO: 2134) | CCCAGTAGCTTTGGACATCTGTCAGCTCTCTACACAC (SEQ ID NO: 2135) | CTCTCCTCTCTCTTCTGGTTAAGACCCCTGGATGG (SEQ ID NO: 2136) |
| TRIM62 | NM_018207.2 | GATTTACTACCTGGCCCCTGGTGGCTTGCAAAATTGTTGGAAGAGCTGGAGAAGCAGACTCTGCTGAATTTCCAGGAACTCCCAGCGCCAGATTCATCAT (SEQ ID NO: 2137) | TCCAGCTCTTCCAACAATTTTGCAAGCCACCAGGGGCCAGGTAGTAAATC (SEQ ID NO: 2138) | ATGATGAATCTGGCGCTGGGAGTTCCTGGAAATTCAGCAGAGTCTGCTTC (SEQ ID NO: 2139) |
| TRIP13 | NM_004237.2 | AAGAGACAGAAAACATAATTGCAGCAAATCACTGGGTTCTACCTGCAGCTGAATTCCATGGGCTTTGGGACAGCTTGGTATACGATGTGGAAGTCAAATC (SEQ ID NO: 2140) | AGCTGCAGGTAGAACCCAGTGATTTGCTGCAATTATGTTTTCTGT (SEQ ID NO: 2141) | GATTTGACTTCCACATCGTATACCAAGCTGTCCCAAAGCCCATGGAATTC (SEQ ID NO: 2142) |
| TTC9 | NM_015351.1 | AGCATCGTATAGGCTAGGGGATTGAACTGTGGACTGATTCAGTGTAAATAAAAACAAATTAACAGGTAGTAGTTCCTGTCAGTTCTGTTGGAAGCAGCCC (SEQ ID NO: 2143) | TATTTACACTGAATCAGTCCACAGTTCAATCCCCTAGCCTATACGATGCT (SEQ ID NO: 2144) | GGGCTGCTTCCAACAGAACTGACAGGAACTACTACCTGTTAATTTGTTTT (SEQ ID NO: 2145) |
| TUBB2C | NM_006088.5 | TGGCGGAGCGTCGGTTGTAGCACTCTGCGCGCCCGCTCTTCTGCTGCTGTTTGTCTACTTCCTCCTGCTTCCCCGCCGCCGCCGCCGCCATCATGAGGGA (SEQ ID NO: 2146) | ACAGCAGCAGAAGAGCGGGCGCGCAGAGTGCTACAA (SEQ ID NO: 2147) | GCGGCGGCGGCGGGGAAGCAGGAGGAAGTAGACAA (SEQ ID NO: 2148) |

TABLE 1-continued

| Gene | GenBank Accession No. | Target Sequence | Capture Probe Sequence | Reporter Probe Sequence |
|---|---|---|---|---|
| TUBG1 | NM_001070.4 | CCCCTCAGAGCACAGATCAGGGACCTCACGCATCTCTTTCTCATATACATGGACTCTCTGTTGGCCTGCAAACACATTTACTTCTCCTCTTATGAGACTA (SEQ ID NO: 2149) | ATGTATATGAGAAAGAGATGCGTGAGGTCCCTGATCTGTGCTCTGAGGGG (SEQ ID NO: 2150) | TAGTCTCATAAGAGGAGAAGTAAATGTGTTTGCAGGCCAACAGAGAGTCC (SEQ ID NO: 2151) |
| TXN | NM_003329.2 | CAGCCAAGATGGTGAAGCAGATCGAGAGCAAGACTGCTTTTCAGGAAGCCTTGGACGCTGCAGGTGATAAACTTGTAGTAGTTGACTTCTCAGCCACGTG (SEQ ID NO: 2152) | GGCTTCCTGAAAAGCAGTCTTGCTCTCGATCTGCTTCACCATCTTGG (SEQ ID NO: 2153) | CACGTGGCTGAGAAGTCAACTACTACAAGTTTATCACCTGCAGCGTCCAA (SEQ ID NO: 2154) |
| TXNDC5 | NM_030810.2 | AGCAGATTGAAATGCAAAAACCCACACCTCTGGAAGATACCTTCACGGCCGCTGCTGGAGCTTCTGTTGCTGTGAATACTTCTCTCAGTGTGAGAGGTTA (SEQ ID NO: 2155) | GGCCGTGAAGGTATCTTCCAGAGGTGTGGGTTTTTGCATTTCAATCTGCT (SEQ ID NO: 2156) | TAACCTCTCACACTGAGAGAAGTATTCACAGCAACAGAAGCTCCAGCAGC (SEQ ID NO: 2157) |
| TYK2 | NM_003331.3 | TCATCGCTGACAGCTGAGGAAGTCTGCATCCACATTGCACATAAAGTTGGTATCACTCCTCCTTGCTTCAATCTCTTTGCCCTCTTCGATGCTCAGGCCC (SEQ ID NO: 2158) | CCAACTTTATGTGCAATGTGGATGCAGACTTCCTCAGCTGTCAGCGATGA (SEQ ID NO: 2159) | GGGCCTGAGCATCGAAGAGGGCAAAGAGATTGAAGCAAGGAGGAGTGATA (SEQ ID NO: 2160) |
| TYMS | NM_001071.1 | TCAGATTATTCAGGACAGGGAGTTGACCAACTGCAAAGAGTGATTGACACCATCAAAACCAACCCTGACGACAGAAGAATCATCATGTGCGCTTGGAATC (SEQ ID NO: 2161) | GTGTCAATCACTCTTTGCAGTTGGTCAACTCCCTGTCCTGAATAATCTGA (SEQ ID NO: 2162) | GATTCCAAGCGCACATGATGATTCTTCTGTCGTCAGGGTTGGTTTTGATG (SEQ ID NO: 2163) |
| UBE2I | NM_003345.3 | CGGCCGCCCGAGGGACTTTGAACATGTCGGGGATCGCCCTCAGCAGACTCGCCCAGGAGAGGAAAGCATGGAGGAAAGACCACCCATTTGGTTTCGTGGC (SEQ ID NO: 2164) | GAGTCTGCTGAGGGCGATCCCCGACATGTTCAAAGTC (SEQ ID NO: 2165) | CACGAAACCAAATGGGTGGTCTTTCCTCCATGCTTTCCTCTCCTGGGC (SEQ ID NO: 2166) |
| UBE2S | NM_014501.2 | CCTCTCCGCCACTTCCCTCGCTTCTGACCATAGTTTGCGGGGAAGGGAGCGAGCGCGTCGAAAACCAAGGAACGTGCGCGCTGACGTCACGGTTGAGGCT (SEQ ID NO: 2167) | GCTCCCTTCCCCGCAAACTATGGTCAGAAGCGAGGGAAGTGG (SEQ ID NO: 2168) | GACGTCAGCGCGCACGTTCCTTGGTTTTCGACGCGCTC (SEQ ID NO: 2169) |
| UBXN4 | NM_014607.3 | CATCGCGACGGCCAAAAGGAGCGGCGC | CTGCCACGAACACCACGAAGACCG | TTTATCATCTTCCCAACTTGCAGCC |

TABLE 1-continued

| Gene | GenBank Accession No. | Target Sequence | Capture Probe Sequence | Reporter Probe Sequence |
| --- | --- | --- | --- | --- |
| | | GGTCTTCGTGGTGT TCGTGGCAGGTGAT GATGAACAGTCTAC ACAGATGGCTGCA AGTTGGGAAGATG ATAAA (SEQ ID NO: 2170) | CGCCGCTCCTTTT GGCCG (SEQ ID NO: 2171) | ATCTGTGTAGAC TGTTCATCATCA C (SEQ ID NO: 2172) |
| USP12 | NM_182488.3 | GTTCTTGCGTATAA GAGTCAACCTAGG AAAAAGGAGAGCC TTCTTACATGCTTA GCAGATCTCTTCCA TAGCATAGCCACTC AGAAGAAAAGGT TGGAG (SEQ ID NO: 2173) | CATGTAAGAAGG CTCTCCTTTTTCC TAGGTTGACTCTT ATACGCAAGAAC (SEQ ID NO: 2174) | CTCCAACCTTTT TCTTCTGAGTGG CTATGCTATGGA AGAGATCTGCTA AG (SEQ ID NO: 2175) |
| USP18 | NM_017414.3 | GGAAATGCCCAAA ACCTTCAGAGATTG ACACGCTGTCATTT TCCATTTCCGTTCC TGGATCTACGGAGT CTTCTAAGAGATTT TGCAATGAGGAGA AGCA (SEQ ID NO: 2176) | GGAAATGGAAAA TGACAGCGTGTC AATCTCTGAAGG TTTTGGGCATTTC C (SEQ ID NO: 2177) | TGCTTCTCCTCA TTGCAAAATCTC TTAGAAGACTCC GTAGATCCAGGA AC (SEQ ID NO: 2178) |
| USP46 | NM_022832.2 | AATACCAGAGTTAG CTGGGTATAGAGGT GGCTCAAAGGAAG TGTCCGTGGGCAGG GGGAGGAATGAAC AAAATGGCGCTGTT TCTTTGGCTCAGAC TCCT (SEQ ID NO: 2179) | CCACGGACACTT CCTTTGAGCCACC TCTATACCCAGCT AACTCTGGTATT (SEQ ID NO: 2180) | AGGAGTCTGAGC CAAAGAAACAG CGCCATTTTGTT CATTCCTCCCCC TGC (SEQ ID NO: 2181) |
| VAC14 | NM_018052.3 | CCACCTCAGTGACA CGGCCATTGGGATG ATGACCAGGATTGC AGTTCTCAAGTGGC TCTACCACCTCTAC ATCAAAACTCCTCG GAAGATGTTCCGGC AC (SEQ ID NO: 2182) | TGAGAACTGCAA TCCTGGTCATCAT CCCAATGGCCGT GTCACTGA (SEQ ID NO: 2183) | CGGAACATCTTC CGAGGAGTTTG ATGTAGAGGTGG TAGAGCCACT (SEQ ID NO: 2184) |
| VASH2 | NM024749.3 | TCAAATCCGAATTT AGCCAAGCCATACC GGCCAGCAAGAGG GTTTCTGTGGTGCT TCTCTCTGCACTTT ACCCAGCATCTTCA GGAGGAACTGCAA CTAT (SEQ ID NO: 2185) | CACAGAAACCCT CTTGCTGGCCGGT ATGGCTTGGCTA AATTCGGATTTGA (SEQ ID NO: 2186) | ATAGTTGCAGTT CCTCCTGAAGAT GCTGGGTAAAGT GCAGAGAGAAG CAC (SEQ ID NO: 2187) |
| VGLL4 | NM_001128220.1 | GCGCTTTCTCAGTC ACAAGCCATGATG AATTGGTGACTCAG ACGCTTTGTGCTTT TTCCTTTGCTTCTTG AGACCGGGTGTGT GTGGCTCAGCTTCC AC (SEQ ID NO: 2188) | ACAAAGCGTCTG AGTCACCAATTC ATCATGGCTTGTG ACTGAGAAAGCG C (SEQ ID NO: 2189) | GTGGAAGCTGAG CCACACACACCC CGGTCTCAAGAA GCAAAGGAAAA AGC (SEQ ID NO: 2190) |
| VMP1 | NM_030938.3 | GATGATGAAGAGT ATCAGGAATTTGAA GAGATGCTGGAAC ATGCAGAGTCTGCA CAAGACTTTGCCTC CCGGGCCAAACTG GCAGTTCAAAAACT AGTAC (SEQ ID NO: 2191) | GACTCTGCATGTT CCAGCATCTCTTC AAATTCCTGATAC TCTTCATCATC (SEQ ID NO: 2192) | GTACTAGTTTTT GAACTGCCAGTT TGGCCCGGGAGG CAAAGTCTTGTG CA (SEQ ID NO: 2193) |

TABLE 1-continued

| Gene | GenBank Accession No. | Target Sequence | Capture Probe Sequence | Reporter Probe Sequence |
|---|---|---|---|---|
| VRK3 | NM_016440.3 | ACAGACAAGAGTGGGCGACAGTGGAAGCTGAAGTCCTTCCAGACCAGGGACAACCAGGGCATTCTCTATGAAGCTGCACCCACCTCCACCCTCACCTGTG (SEQ ID NO: 2194) | TCCCTGGTCTGGAAGGACTTCAGCTTCCACTGTCG (SEQ ID NO: 2195) | TGGAGGTGGGTGCAGCTTCATAGAGAATGCCCTGGTTG (SEQ ID NO: 2196) |
| VWF | NM_000552.3 | CACCTGCAACCCCTGCCCCCTGGGTTACAAGGAAGAAAATAACACAGGTGAATGTTGTGGGAGATGTTTGCCTACGGCTTGCACCATTCAGCTAAGAGGA (SEQ ID NO: 2197) | CACCTGTGTTATTTTCTTCCTTGTAACCCAGGGGGCAGGGGTTGCAGGTG (SEQ ID NO: 2198) | TCCTCTTAGCTGAATGGTGCAAGCCGTAGGCAAACATCTCCCACAACATT (SEQ ID NO: 2199) |
| WAC | NM_100486.2 | CCTCTGGACTGAACCCCACATCTGCACCTCCAACATCTGCTTCAGCGGTCCCTGTTTCTCCTGTTCCACAGTCGCCAATACCTCCCTTACTTCAGGACCC (SEQ ID NO: 2200) | GACCGCTGAAGCAGATGTTGGAGGTGCAGATGTGGGGTT (SEQ ID NO: 2201) | GGGTCCTGAAGTAAGGGAGGTATTGGCGACTGTGGAACAGGAGAAACAGG (SEQ ID NO: 2202) |
| WASF1 | NM_001024934.1 | TGGCCCAGCCTCTCATTTTGAAACAAGACCTCAGACATACGTGGATCATATGGATGGATCTTACTCACTTTCTGCCTTGCCATTTAGTCAGATGAGTGAG (SEQ ID NO: 2203) | TATGATCCACGTATGTCTGAGGTCTTGTTTCAAAATGAGAGGCTGGGCCA (SEQ ID NO: 2204) | CTCACTCATCTGACTAAATGGCAAGGCAGAAAGTGAGTAAGATCCATCCA (SEQ ID NO: 2205) |
| WDR25 | NM024515.4 | GCATCCTCAGTGGTGGCTTTGACTTCGCGCTGCACCTAACAGACCTTGAAACAGGAACCCAGCTATTTAGTGGTCGAAGTGACTTTAGAATCACTACCTT (SEQ ID NO: 2206) | TTCAAGGTCTGTTAGGTGCAGCGCGAAGTCAAAGCCACCACTGAG (SEQ ID NO: 2207) | AAGGTAGTGATTCTAAAGTCACTTCGACCACTAAATAGCTGGGTTCCTGT (SEQ ID NO: 2208) |
| WDR55 | NM_017706.4 | CTACCTCTTCAATTGGAATGGCTTTGGGGCCACAAGTGACCGCTTTGCCCTGAGAGCTGAATCTATCGACTGCATGGTTCCAGTCACCGAGAGTCTGCTG (SEQ ID NO: 2209) | GGGCAAAGCGGTCACTTGTGGCCCCAAAGCCATTCCAATTGAAGAG (SEQ ID NO: 2210) | GACTCTCGGTGACTGGAACCATGCAGTCGATAGATTCAGCTCTCA (SEQ ID NO: 2211) |
| WFDC9 | NM_147198.2 | CAGAGTATTGGAAAAGACTTGCCTTCTGCCAGAACTTAACCCAAATACACACAGAGAGCACCATGAAGCCCTGGATTCTTCTACTCGTCATGTTCATCT (SEQ ID NO: 2212) | TGTATTTGGGTTAAGTTCTGGCAGAAGGCAAGTCTTTTCCCAATACTCTG (SEQ ID NO: 2213) | AGATGAACATGACGAGTAGAAGAATCCAGGGCTTCATGGTGCTCTCTGTG (SEQ ID NO: 2214) |
| WHSC1 | NM_007331.1 | AAAAGAGTGCACGCCAGTATCACGTAC | TTCTGGGGCGTCACCAAAGAACTGT | TGTCCTTCTCCTTCAAAAGCTACGA |

TABLE 1-continued

| Gene | GenBank Accession No. | Target Sequence | Capture Probe Sequence | Reporter Probe Sequence |
|------|----------------------|-----------------|------------------------|-------------------------|
| | | AGTTCTTTGGTGAC GCCCCAGAAAGAG CTTGGATATTTGAG AAGAGCCTCGTAGC TTTTGAAGGAGAAG GACA (SEQ ID NO: 2215) | ACGTGATACTGG CGTGCACTCTTTT (SEQ ID NO: 2216) | GGCTCTTCTCAA ATATCCAAGCTC T (SEQ ID NO: 2217) |
| WNT3 | NM_030753.3 | CCAACTCGCCTGTG GACGGGGAGGCTC TCCCTCTCTCTCAT CTTACATTTCTCAC CCTACTCTGGATGG TGTGTGGTTTTTAA AGAAGGGGCTTTC TTT (SEQ ID NO: 2218) | ATGTAAGATGAG AGAGAGGGAGAG CCTCCCCGTCCAC AGGCGAGTTGG (SEQ ID NO: 2219) | AAAGAAAGCCC CCTTCTTTAAAA ACCACACACCAT CCAGAGTAGGGT GAGAA (SEQ ID NO: 2220) |
| XAF1 | NM_017523.2 | TGGTTTGCCCAAGG ACTACAAATAAACC AACGGGAAAAAAG AAAGGTTCCAGTTT TGTCTGAAAATTCT GATTAAGCCTCTGG GCCCTACAGCCTGG AGA (SEQ ID NO: 2221) | GGAACCTTTCTTT TTTCCCGTTGGTT TATTTGTAGTCCT TGGGCAAAC (SEQ ID NO: 2222) | TCTCCAGGCTGT AGGGCCCAGAG GCTTAATCAGAA TTTTCAGACAAA ACT (SEQ ID NO: 2223) |
| XBP1 | NM_005080.2 | GGAGTTAAGACAG CGCTTGGGGATGGA TGCCCTGGTTGCTG AAGAGGAGGCGGA AGCCAAGGGGAAT GAAGTGAGGCCAG TGGCCGGGTCTGCT GAGTCC (SEQ ID NO: 2224) | CCTCCTCTTCAGC AACCAGGGCATC CATCCCCAAG (SEQ ID NO: 2225) | CGGCCACTGGCC TCACTTCATTCC CCTTGGCTTCCG (SEQ ID NO: 2226) |
| YPEL1 | NM_013313.3 | ATAGAGGGGCCTGT GCAATCTCCTAAGG CCTGTGTTTCTGCC ATATATTTTATTAT AAATTACAATCCAC TCATCCACCTGCCC TCCACCAGGAGTGG GC (SEQ ID NO: 2227) | AAATATATGGCA GAAACACAGGCC TTAGGAGATTGC ACAGGCCCCTCT AT (SEQ ID NO: 2228) | CCCACTCCTGGT GGAGGGCAGGT GGATGAGTGGAT TGTAATTTATAA TA (SEQ ID NO: 2229) |
| ZAP70 | NM_001079.3 | GGAGCTCAAGGAC AAGAAGCTCTTCCT GAAGCGCGATAAC CTCCTCATAGCTGA CATTGAACTTGGCT GCGGCAACTTTGGC TCAGTGCGCCAGGG CGTG (SEQ ID NO: 2230) | CTATGAGGAGGT TATCGCGCTTCAG GAAGAGCTTCTT GTCCTTGAGCTCC (SEQ ID NO: 2231) | CTGGCGCACTGA GCCAAAGTTGCC GCAGCCAAGTTC AATGTCAG (SEQ ID NO: 2232) |
| ZBTB32 | NM_014383.1 | AGGCCGTCTCGGCC CTCGACCTCTCCCT GTTGTCCTTCTTCCT CCACCACCTGACGG GGTGTCGGTAGCGT CTTAGCCAAGAGTC CAATTAAAGAACG AA (SEQ ID NO: 2233) | GTGGTGGAGGAA GAAGGACAACAG GGAGAGGTCGAG GGCCGAGACG (SEQ ID NO: 2234) | TTCGTTCTTTAAT TGGACTCTTGGC TAAGACGCTACC GACACCCCGTCA G (SEQ ID NO: 2235) |
| ZBTB37 | NM_001122770.1 | GAACATACAATTGG AGATTCCTGACTTC AGCAACTCTGTCCT GAGCCATCTAAACC AGTTGCGCATGCAG GGCCGTCTCTGTGA TATTGTGGTCAATG TG (SEQ ID NO: 2236) | GATGGCTCAGGA CAGAGTTGCTGA AGTCAGGAATCT CCAATTGTATGTT C (SEQ ID NO: 2237) | CACATTGACCAC AATATCACAGAG ACGGCCCTGCAT GCGCAACTGGTT TA (SEQ ID NO: 2238) |

TABLE 1-continued

| Gene | GenBank Accession No. | Target Sequence | Capture Probe Sequence | Reporter Probe Sequence |
|---|---|---|---|---|
| ZBTB38 | XM_929657.1 | CAAGACCTGCGGA CGGTGCTTTTCGGT GCAAGGAAACTTA CAGAAACATGAAC GCATCCACCTGGGC TTGAAGGAGTTCGT CTGTCAGTATTGCA ACAAG (SEQ ID NO: 2239) | CATGTTTCTGTAA GTTTCCTTGCACC GAAAAGCACCGT CCGCAGGTCTTG (SEQ ID NO: 2240) | CTTGTTGCAATA CTGACAGACGAA CTCCTTCAAGCC CAGGTGGATGCG TT (SEQ ID NO: 2241) |
| ZBTB8A | NM_001040441.1 | TGGAGATAAGGATT CCAGATGGCACTTG AGTGAAGATGAGA ATAGATCCTATGTG GAGATTGTAGAAG ATGGGTCTGGTGAT CTGGTCATCCAACA GGTT (SEQ ID NO: 2242) | AGGATCTATTCTC ATCTTCACTCAAG TGCCATCTGGAAT CCTTATCTCCA (SEQ ID NO: 2243) | AACCTGTTGGAT GACCAGATCACC AGACCCATCTTC TACAATCTCCAC AT (SEQ ID NO: 2244) |
| ZCCHC2 | NM_017742.4 | GGCCAACAGCTTGC ACTGGAGAATCGG AAAAGCACCTTGA GTTACTGGCTTCCC CTTTACCTATTCCA TCAACCTTCCTTCC ACACAGTAGTACTC CCGC (SEQ ID NO: 2245) | AGCCAGTAACTC AAGGTGCTTTTCC GATTCTCCAGTGC AAGCTGTTGGC (SEQ ID NO: 2246) | GCGGGAGTACTA CTGTGTGGAAGG AAGGTTGATGGA ATAGGTAAAGG GGA (SEQ ID NO: 2247) |
| ZCCHC7 | NM_032226.2 | CTGCTGAAGCTGTT GTCAGAATCTTCCT TTGGACAAAACATC ACTAGCTGACTATA AAAACAAAAGTGT CATCATTGAAGCCC TGAAGAGGCAGGG AATT (SEQ ID NO: 2248) | CAGCTAGTGATG TTTTGTCCAAAGG AAGATTCTGACA ACAGCTTCAGCA G (SEQ ID NO: 2249) | AATTCCCTGCCT CTTCAGGGCTTC AATGATGACACT TTTGTTTTATAG T (SEQ ID NO: 2250) |
| ZFP36L1 | NM_004926.2 | CCACGTGCCCATCT CAAGACATTCCACT CACAGATTTGAGGT TCTGGATTCCAGGT CTGGAGTTTTCCAA TGTTAATGTAAACA GAACTGGCACACA CAC (SEQ ID NO: 2251) | AATCCAGAACCT CAAATCTGTGAG TGGAATGTCTTGA GATGGGCACGTG G (SEQ ID NO: 2252) | GTGTGTGTGCCA GTTCTGTTTACA TTAACATTGGAA AACTCCAGACCT GG (SEQ ID NO: 2253) |
| ZFP42 | NM_174900.3 | AAAGAATATGACA GTCTGAGCGCAATC GCTTGTCCTCAGAG TGGATGCACTAGGA AGTTGAGGAATAG AGCTGCCCTGAGAA AGCATCTCCTCATT CATG (SEQ ID NO: 2254) | GTGCATCCACTCT GAGGACAAGCGA TTGCGCTCAGACT GTCATATTCTTT (SEQ ID NO: 2255) | CATGAATGAGGA GATGCTTTCTCA GGGCAGCTCTAT TCCTCAACTTCC TA (SEQ ID NO: 2256) |
| ZMYND8 | NM_183047.1 | GTTGGGATCGGGA GTTTCGGCACAGAC TATCCCATCAAGCC GTTGGCTCCTTTCA GCTACTACGTTACC ACGTTCCTAAAACG CAAGCTCTCCGGAC CAG (SEQ ID NO: 2257) | GGAGCCAACGGC TTGATGGGATAG TCTGTGCCGAAA CTCCCGATC (SEQ ID NO: 2258) | CTGGTCCGGAGA GCTTGCGTTTTA GGAACGTGGTAA CGTAGTAGCTGA AA (SEQ ID NO: 2259) |
| ZNF135 | NM_003436.2 | ACTAGACCCAAAGT CAAACTGTCAGTTC | TCTTCAGAGATGC CTTGCTTTAGAAC | ACAGACCATCCC ACAGGAATCTTT |

TABLE 1-continued

| Gene | GenBank Accession No. | Target Sequence | Capture Probe Sequence | Reporter Probe Sequence |
|---|---|---|---|---|
| | | TAAAGCAAGGCAT CTCTGAAGAAATAT CCAACAGTGTCATC TTGGTAGAAAGATT CCTGTGGGATGGTC TGT (SEQ ID NO: 2260) | TGACAGTTTGACT TTGGGTCTAGT (SEQ ID NO: 2261) | CTACCAAGATGA CACTGTTGGATA TT (SEQ ID NO: 2262) |
| ZNF238 | NM_006352.3 | GGGACTGGAGCGC TGAAAAGTTGTTCC TGACCAGGCTCTAA TGAGAAATTCCTCT CTCCCCAGGTTATG AAGACAGTATGGA GTTTCCAGACCATA GTAG (SEQ ID NO: 2263) | AATTTCTCATTAG AGCCTGGTCAGG AACAACTTTTCAG CGCTCCAGTCCC (SEQ ID NO: 2264) | CTACTATGGTCT GGAAACTCCATA CTGTCTTCATAA CCTGGGGAGAG AGG (SEQ ID NO: 2265) |
| ZNF281 | NM_012482.3 | AGCGTTTGGTTCTC AGTTTAAGTCGGGC AGCAGGGTGCCAA TGACCTTTATCACT AACTCTAATGGAGA AGTGGACCATAGA GTAAGGACTTCAGT GTCA (SEQ ID NO: 2266) | TAAAGGTCATTG GCACCCTGCTGCC CGACTTAAACTG AGAACCAAACGC T (SEQ ID NO: 2267) | TGACACTGAAGT CCTTACTCTATG GTCCACTTCTCC ATTAGAGTTAGT GA (SEQ ID NO: 2268) |
| ZNF318 | NM_014345.2 | TCCGACCCAACCTG CCTATTCCATCCAC AGTACTCCGCAAGT CATGTTCAGCCACA ATGAGCAAGCCAG CTCCTCTTAACACC TTTCTGTCTATTAA GTC (SEQ ID NO: 2269) | TGAACATGACTT GCGGAGTACTGT GGATGGAATAGG CAGGTTGGGTCG GA (SEQ ID NO: 2270) | GACTTAATAGAC AGAAAGGTGTTA AGAGGAGCTGG CTTGCTCATTGT GGC (SEQ ID NO: 2271) |
| ZNF385B | NM_001113398.1 | CTGACAAATCAGA AGATAAAGGGAAG TTAAAAGCCAGCA GTTCCAGTCAGCCA TCAAGCTCTGAAAG TGGCTCATTTCTCC TCAAATCTGGCACA ACACC (SEQ ID NO: 2272) | CTGACTGGAACT GCTGGCTTTTAAC TTCCCTTTATCTT CTGATTTGTCAG (SEQ ID NO: 2273) | GGTGTTGTGCCA GATTTGAGGAGA AATGAGCCACTT TCAGAGCTTGAT GG (SEQ ID NO: 2274) |
| ZNF598 | NM_178167.2 | TCAGACAGGGCCTG ATCTCCGCAGCCCA GTATTACAAGAGTT GCCGGGACCTGCTG GGGGAGAATTTCCA GAAGGTCTTTAATG AGCTGCTGGTCCTG CT (SEQ ID NO: 2275) | GTCCCGGCAACT CTTGTAATACTGG GCTGCGGAGATC AGG (SEQ ID NO: 2276) | ACCAGCAGCTCA TTAAAGACCTTC TGGAAATTCTCC CCCAGCAG (SEQ ID NO: 2277) |
| ZNF608 | NM_020747.2 | CAGCACAATCATCT CAACTGAAAGAGT CCCATTCTCCCTAT TACCACAGCTATGA TCCTTATTATTCTCC AAGTTACATGCACC CTGGGCAGGTCGGT GC (SEQ ID NO: 2278) | GCTGTGGTAATA GGGAGAATGGGA CTCTTTCAGTTGA GATGATTGTGCTG (SEQ ID NO: 2279) | GCACCGACCTGC CCAGGGTGCATG TAACTTGGAGAA TAATAAGGATCA TA (SEQ ID NO: 2280) |
| ZNRF1 | NM_032268.4 | ATAGCTTTGTCACC ACAAAGGGCACTG TTCTATTCACAGCA CCTCCTGCTTCTGC CTGGCAACTGTGTC TCCCTGTGCTATAT TTAATTCCACCAGC AAA (SEQ ID NO: 2281) | AGCAGGAGGTGC TGTGAATAGAAC AGTGCCCTTTGTG GTGACAAAGCTA T (SEQ ID NO: 2282) | TTTGCTGGTGGA ATTAAATATAGC ACAGGGAGACA CAGTTGCCAGGC AGA (SEQ ID NO: 2283) |

TABLE 1-continued

| Gene | GenBank Accession No. | Target Sequence | Capture Probe Sequence | Reporter Probe Sequence |
| --- | --- | --- | --- | --- |
| ZPBP2 | NM_198844.2 | TGCAAGTAGTACGT CTGGATAGCTGTCG ACCAGGCTTTGGAA AAAATGAACGTCTA CACAGTAATTGCGC TAGCTGTTGTGTGG TTTGTAGTCCTGCG AC (SEQ ID NO: 2284) | TTCATTTTTTCCA AAGCCTGGTCGA CAGCTATCCAGA CGTACTACTTGCA (SEQ ID NO: 2285) | GTCGCAGGACTA CAAACCACACAA CAGCTAGCGCAA TTACTGTGTAGA CG (SEQ ID NO: 2286) |
| ZWINT | NM_007057.3 | GGAGATGTAAATTT GCCATGACTTCCTG GAGGACAGCAGCA TGGAGAAAGATCCT AGAAAAGGCCTCT GACTTCCCTCACCT CCCAACCATCATTA CAGG (SEQ ID NO: 2287) | CTTTCTCCATGCT GCTGTCCTCCAGG AAGTCATGGCAA ATTTACA (SEQ ID NO: 2288) | TAATGATGGTTG GGAGGTGAGGG AAGTCAGAGGCC TTTTCTAGGAT (SEQ ID NO: 2289) |
| IgG2 constant region | NCI_Lih_1_008.1 | TCCCCAGGCTCTCG GGGTCGCGCGAGG ATGCTTGGCACGTA CCCCGTCTACATAC TTCCCGGGCACCCA GCATGGAAATAAA GCACCCAGCGCTGC CCTG (SEQ ID NO: 2290) | TAGACGGGGTAC GTGCCAAGCATC CTCGCGCGACCC CGAG (SEQ ID NO: 2291) | CTGGGTGCTTTA TTTTCCATGCTGG GTGCCCGGGAAG TATG (SEQ ID NO: 2292) |
| IgG4 constant region | NCI_Lih_1_034.1 | GATGGCGTGGAGG TGCATAATGCCAAG ACAAAGCCGCGGG AGGAGCAGTTCAA CAGCACGTACCGTG TGGTCAGCGTCCTC ACCGTCCTGCACCA GGACT (SEQ ID NO: 2293) | AACTGCTCCTCCC GCGGCTTTGTCTT GGCATTATG (SEQ ID NO: 2294) | TGCAGGACGGTG AGGACGCTGACC ACACGGTACGTG CTGTTG (SEQ ID NO: 2295) |
| IgA2 constant region | NCI_Lih_1_017.1 | GCCGCTGGCCTTCA CACAGAAGACCAT CGACCGCTTGGCGG GTAAACCCACCCAT GTCAATGTGTCTGT TGTCATGGCGGAGG TGGACGGCACCTGC TAC (SEQ ID NO: 2296) | TGGGTTTACCCGC CAAGCGGTCGAT GGTCTTCTGTGTG AAGG (SEQ ID NO: 2297) | AGGTGCCGTCCA CCTCCGCCATGA CAACAGACACAT TGACATGGG (SEQ ID NO: 2298) |
| IgE constant region | NCI_Lih_1_009.1 | AAGACCAAGGGCT CCGGCTTCTTCGTC TTCAGCCGCCTGGA GGTGACCAGGGCC GAATGGGAGCAGA AAGATGAGTTCATC TGCCGTGCAGTCCA TGAGG (SEQ ID NO: 2299) | CTGGTCACCTCCA GGCGGCTGAAGA CGAAGAAGCCGG AGC (SEQ ID NO: 2300) | CACGGCAGATGA ACTCATCTTTCT GCTCCCATTCGG CC (SEQ ID NO: 2301) |
| EBV LMP1 unique | NCI_Lih_1_001.1 | TTGCTTTCCATCTT GTGCCAATACACAT TTGGATTCAGCCCA AGCCACACCTAACT CATGCCAGCAGAG GCAGGAACACCTGT TGTTGACACATTCT TTG (SEQ ID NO: 2302) | GTGTGGCTTGGG CTGAATCCAAAT GTGTATTGGCAC AAGATGGAAAGC AA (SEQ ID NO: 2303) | CAAAGAATGTGT CAACAACAGGTG TTCCTGCCTCTG CTGGCATGAGTT AG (SEQ ID NO: 2304) |
| EBV LMP1 3' end | NCI_Lih_1_025.1 | CTGTTTGGACTTTT ATGCCTGCTCCTCA | GGTCGCATGGTG GCTTCTTAGATGA | TGAAGGAACGG CGGAGAGTAGC |

TABLE 1-continued

| Gene | GenBank Accession No. | Target Sequence | Capture Probe Sequence | Reporter Probe Sequence |
|---|---|---|---|---|
| | | TCTAAGAAGCCACC ATGCGACCGGGTA GACCACTGGCTGGA TTCTACGCTACTCT CCGCCGTTCCTTCA GAA (SEQ ID NO: 2305) | GGAGCAGGCATA AAAGTCCAAACA G (SEQ ID NO: 2306) | GTAGAATCCAGC CAGTGGTCTACC C (SEQ ID NO: 2307) |
| EBV EBNA2 3' end | NCI_Lih_1_043.1 | AATTCACACACGGC AACCCCTAACGTTT CACCAATACATGAA CCGGAGTCCCATAA TAGCCCAGAGGCTC CCATTCTCTTCCCC GATGATTGGTATCC TC (SEQ ID NO: 2308) | GACTCCGGTTCAT GTATTGGTGAAA CGTTAGGGGTTG CCGTGTGTGAATT (SEQ ID NO: 2309) | GAGGATACCAAT CATCGGGGAAG AGAATGGGAGC CTCTGGGCTATT ATGG (SEQ ID NO: 2310) |
| EBV EBNA2 long | NCI_Lih_1_006.1 | AATTGTTGACACGG ATAGTCTTGGAAAC CCGTCACTCTCAGT AATTCCCTCGAATC CCTACCAGGAACA ACTGTCAGACACTC CATTAATTCCACTA ACA (SEQ ID NO: 2311) | AGGGAATTACTG AGAGTGACGGGT TTCCAAGACTATC CGTGTCAACAATT (SEQ ID NO: 2312) | TGTTAGTGGAAT TAATGGAGTGTC TGACAGTTGTTC CTGGTAGGGATT CG (SEQ ID NO: 2313) |
| EBV EBNA1 CDS | NCI_Lih_1_024.1 | GAGGTTTTGAAGGA TGCGATTAAGGACC TTGTTATGACAAAG CCCGCTCCTACCTG CAATATCAGGGTGA CTGTGTGCAGCTTT GACGATGGAGTAG ATT (SEQ ID NO: 2314) | GGAGCGGGCTTT GTCATAACAAGG TCCTTAATCGCAT CCTTCAAAACCTC (SEQ ID NO: 2315) | AATCTACTCCAT CGTCAAAGCTGC ACACAGTCACCC TGATATTGCAGG TA (SEQ ID NO: 2316) |
| EBV LPM2A | NCI_Lih_1_004.1 | GAGGAAGTATGAA TCCAGTATGCCTGC CTGTAATTGTTGCG CCCTACCTCTTTTG GCTGGCGGCTATTG CCGCCTCGTGTTTC ACGGCCTCAGTTAG TAC (SEQ ID NO: 2317) | GAGGTAGGGCGC AACAATTACAGG CAGGCATACTGG ATTCATACTTCCT C (SEQ ID NO: 2318) | GTACTAACTGAG GCCGTGAAACAC GAGGCGGCAAT AGCCGCCAGCCA AAA (SEQ ID NO: 2319) |
| EBV BZLF1 | NCI_Lih_1_027.1 | TGCCCAAGCCTGGA TGTTGACTCCATTA TCCGCCGGACACCA GATGTTTTACACGA GGATCTCTTAAATT TCTAACTCCCGTTA TTGAAACCACGCCT GC (SEQ ID NO: 2320) | AAAACATCTGGT GTCCGGCGGATA ATGGAGTCAACA TCCAGGCTTGGG CA (SEQ ID NO: 2321) | GCAGGCGTGGTT TCAATAACGGGA GTTAGAAATTTA AGAGATCCTCGT GT (SEQ ID NO: 2322) |
| EBV EBNA3A | NCI_Lih_1_020.1 | CCAACATCAGCTGG ATGCTTTGGGGTAT ACACTCCATGGTCT TAACCATCCCGGGG TTCCCGTGTCTCCT GCCGTTAACCAATA TCATCTCAGCCAGG CT (SEQ ID NO: 2323) | GATGGTTAAGAC CATGGAGTGTAT ACCCCAAAGCAT CCAGCTGATGTTG G (SEQ ID NO: 2324) | AGCCTGGCTGAG ATGATATTGGTT AACGGCAGGAG ACACGGGAACCC CGG (SEQ ID NO: 2325) |
| EBV EBNA3C | NCI_Lih_1_022.1 | ACAATCGGAAACTT TAAGCCATATTACC CGTGGAATGCACCA CCTAATGAAAATCC ATATCACGCGCGGA GAGGCATAAAAGA ACACGTAATCCAGA ACG (SEQ ID NO: 2326) | TCATTAGGTGGTG CATTCCACGGGT AATATGGCTTAA AGTTTCCGATTGT (SEQ ID NO: 2327) | CGTTCTGGATTA CGTGTTCTTTTAT GCCTCTCCGCGC GTGATATGGATT T (SEQ ID NO: 2328) |

TABLE 1-continued

| Gene | GenBank Accession No. | Target Sequence | Capture Probe Sequence | Reporter Probe Sequence |
|---|---|---|---|---|
| EBV EBNA3B | NCI_Lih_1_003.1 | CTCCCGTCGTTATC TTGGAGAATGTCGG CCAGGGGCAACAG CAGACTCTGGAGTG CGGAGGAACTGCT AAACAGGAAAGGG ACATGTTGGGCTG GGGGA (SEQ ID NO: 2329) | CAGAGTCTGCTGT TGCCCCTGGCCG ACATTCTCCAAG ATAACGACGGGA G (SEQ ID NO: 2330) | CAACATGTCCCT TTCCTGTTTAGC AGTTCCTCCGCA CTC (SEQ ID NO: 2331) |
| HHV8 T0.7/P6 | NCI_Lih_1_040.1 | CGGTGTTTGTGGCA GTTCATGTCCGGA TGTGTTACTAAATG GGTGGCGCTGGAG GCTTGGGGCGATAC CACCACTCGTTTGT CTGTTGGCGATTGG TGT (SEQ ID NO: 2332) | GCGCCACCCATTT AGTAACACATCC GGGACATGAACT GCCACAAACACC G (SEQ ID NO: 2333) | ACACCAATCGCC AACAGACAAAC GAGTGGTGGTAT CGCCCCAAGCCT CCA (SEQ ID NO: 2334) |
| HHV8 T1.1 | NCI_Lih_1_007.1 | AGCAAGTCGATTTG AATGACATAGGCG ACAAAGTGAGGTG GCATTTGTCAGAAG TTTCAAAGTCGTGT AAGAACATTGGACT AAAGTGGTGTGCG GCAGC (SEQ ID NO: 2335) | TGACAAATGCCA CCTCACTTTGTCG CCTATGTCATTCA AATCGACTTGCT (SEQ ID NO: 2336) | GCTGCCGCACAC CACTTTAGTCCA ATGTTCTTACAC GACTTTGAAACT TC (SEQ ID NO: 2337) |
| HHV8 ORF73/LAN A | NCI_Lih_1_037.1 | CCATAATCTTGCAC GGGTCGTCATCCGA GGACGAAATGGAA GTGGATTACCCTGT TGTTAGCACACATG AACAAATTGCCAGT AGCCCACCAGGAG ATAA (SEQ ID NO: 2338) | GTAATCCACTTCC ATTTCGTCCTCGG ATGACGACCCGT GCAAGATTATGG (SEQ ID NO: 2339) | TTATCTCCTGGT GGGCTACTGGCA ATTTGTTCATGT GTGCTAACAACA GG (SEQ ID NO: 2340) |
| HHV8 vFLIP ORF71 | NCI_Lih_1_021.1 | TGTTCTCCACGTAG ACGGGGAGCTGTGT GCGAGGGATATTA GGTCTTTGATATTT TTAAGCAAGGACA CTATAGGGTCTCGC AGCACACCACAGA CATTC (SEQ ID NO: 2341) | TCAAAGACCTAA TATCCCTCGCACA CAGCTCCCCGTCT ACGTGGAGAACA (SEQ ID NO: 2342) | GAATGTCTGTGG TGTGCTGCGAGA CCCTATAGTGTC CTTGCTTAAAAA TA (SEQ ID NO: 2343) |
| HHV8 BCL2 homologue | NCI_Lih_1_010.1 | ATCACAGGCTTAAT GCGAGACAAGGAG TCTTTATTCGAGGC CATGTTGGCTAATG TGAGATTTCACAGC ACCACCGGTATAAA CCAGCTTGGGTTGA GCA (SEQ ID NO: 2344) | GCCAACATGGCC TCGAATAAAGAC TCCTTGTCTCGCA TTAAGCCTGTGAT (SEQ ID NO: 2345) | TGCTCAACCCAA GCTGGTTTATAC CGGTGGTGCTGT GAAATCTCACAT TA (SEQ ID NO: 2346) |
| HHV8 vMIP 1b ORFK4.2 KIE-3 | NCI_Lih_1_041.1 | ATTAGCGCATGCAA ATTAGCTTTGCCGA AGTTCTCGGAAAGC CGGTGGGGCGCGCT GGATTTTTGGACCG TGGGAAATGGGAC CGGTGTCCTCTCTA TGA (SEQ ID NO: 2347) | CCCCACCGGCTTT CCGAGAACTTCG GCAAAGCTAATT TGCATGCGCTAAT (SEQ ID NO: 2348) | TCATAGAGAGGA CACCGGTCCCAT TTCCCACGGTCC AAAAATCCAGCG CG (SEQ ID NO: 2349) |
| HHV8 vIL6 | NCI_Lih_1_026.1 | CGTACCGGCATCTG CAAGGGTATTCTAG | AGATGAAAAATA GCAGCGGGCTCT | TAAATCCTATTA ACCCGCAGTGAT |

TABLE 1-continued

| Gene | GenBank Accession No. | Target Sequence | Capture Probe Sequence | Reporter Probe Sequence |
|---|---|---|---|---|
| | | AGCCCGCTGCTATT TTTCATCTGAAACT ACCAGCCATCAACG ATACTGATCACTGC GGGTTAATAGGATT TA (SEQ ID NO: 2350) | AGAATACCCTTG CAGATGCCGGTA CG (SEQ ID NO: 2351) | CAGTATCGTTGA TGGCTGGTAGTT TC (SEQ ID NO: 2352) |
| HHV8 K1-32 BCb K1 protein | NCI_Lih_1_015.1 | TCGGATTCATCCTT GCCAATATCCTGGT ATTGCAACGATACT CGGCTTTGGCGACT GACGAAGCCAACA CTCACTATTGACAT CATTACCTGCAATT TTA (SEQ ID NO: 2353) | CAAAGCCGAGTA TCGTTGCAATACC AGGATATTGGCA AGGATGAATCCG A (SEQ ID NO: 2354) | TAAAATTGCAGG TAATGATGTCAA TAGTGAGTGTTG GCTTCGTCAGTC GC (SEQ ID NO: 2355) |
| EBV EBER1 | NCI_Lih_1_016.1 | TGTAGCCACCCGTC CCGGGTACAAGTCC CGGGTGGTGAGGA CGGTGTCTGTGGTT GTCTTCCCAGACTC TGCTTTCTGCCGTC TTCGGTCAAGTACC AGC (SEQ ID NO: 2356) | CAGACACCGTCC TCACCACCCGGG ACTTGTACCCG (SEQ ID NO: 2357) | GCTGGTACTTGA CCGAAGACGGC AGAAAGCAGAG TCTGGGAAGACA ACCA (SEQ ID NO: 2358) |
| EBV EBER2 | NCI_Lih_1_014.1 | GTCCCGGGGGAGG AGAAGAGAGGCTT CCCGCCTAGAGCAT TTGCAAGTCAGGAT TCTCTAATCCCTCT GGGAGAAGGGTAT TCGGCTTGTCCGCT ATTTT (SEQ ID NO: 2359) | TGACTTGCAAAT GCTCTAGGCGGG AAGCCTCTCTTCT CCTC (SEQ ID NO: 2360) | AAAATAGCGGA CAAGCCGAATAC CCTTCTCCCAGA GGGATTAGAGA ATCC (SEQ ID NO: 2361) |
| BCL2_1 | NCI_Lih_1_013.1 | TCTTGATTCTTCAA AAGCATTCTGAGAA GGTGAGATAAGCC CTGAGTCTCAGCTA CCTAAGAAAAACCT GGATGTCACTGGCC ACTGAGGAGCTTTG TTT (SEQ ID NO: 2362) | GAGACTCAGGGC TTATCTCACCTTC TCAGAATGCTTTT GAAGAATCAAGA (SEQ ID NO: 2363) | AAACAAAGCTCC TCAGTGGCCAGT GACATCCAGGTT TTTCTTAGGTAG CT (SEQ ID NO: 2364) |
| BCL2_2 | NCI_Lih_1_028.1 | TGGCCTTCTTTGAG TTCGGTGGGGTCAT GTGTGTGGAGAGC GTCAACCGGGAGA TGTCGCCCCTGGTG GACAACATCGCCCT GTGGATGACTGAGT ACCT (SEQ ID NO: 2365) | CCGGTTGACGCTC TCCACACACATG ACCCCACCGAAC TCAAAGAAGGCC A (SEQ ID NO: 2366) | CACAGGGCGATG TTGTCCACCAGG GGCGACATCTC (SEQ ID NO: 2367) |
| BCL2_3 | NCI_Lih_1_038.1 | ATTCTGCAACACTG TACACATAAAAAAT ACGGTAAGGATACT TTACATGGTTAAGG TAAAGTAAGTCTCC AGTTGGCCACCATT AGCTATAATGGCAC TT (SEQ ID NO: 2368) | CCATGTAAAGTA TCCTTACCGTATT TTTTATGTGTACA GTGTTGCAGAAT (SEQ ID NO: 2369) | AAGTGCCATTAT AGCTAATGGTGG CCAACTGGAGAC TTACTTTACCTT AA (SEQ ID NO: 2370) |
| BCL2_4 | NCI_Lih_1_035.1 | GAACTTGAGGAAG TGAACATTTCGGTG ACTTCCGCATCAGG AAGGCTAGAGTTAC CCAGAGCATCAGG CCGCCACAAGTGCC TGCTTTTAGGAGAC CGAA (SEQ ID NO: 2371) | TCTAGCCTTCCTG ATGCGGAAGTCA CCGAAATGTTCA CTTCCTCAAGTTC (SEQ ID NO: 2372) | TCTCCTAAAAGC AGGCACTTGTGG CGGCCTGATGCT CTGGGTAAC (SEQ ID NO: 2373) |

TABLE 1-continued

| Gene | GenBank Accession No. | Target Sequence | Capture Probe Sequence | Reporter Probe Sequence |
|---|---|---|---|---|
| BCL2_5 | NCI_Lih_1_011.1 | TCAGGGAGTTGGA AGTTTTCAGAATAA CCAGAACTAAGGG TATGAAGGACCTGT ATTGGGGTCGATGT GATGCCTCTGCGAA GAACCTTGTGTGAC AAAT (SEQ ID NO: 2374) | GTCCTTCATACCC TTAGTTCTGGTTA TTCTGAAAACTTC CAACTCCCTGA (SEQ ID NO: 2375) | ATTTGTCACACA AGGTTCTTCGCA GAGGCATCACAT CGACCCCAATAC AG (SEQ ID NO: 2376) |
| BCL2_6 | NCI_Lih_1_032.1 | CGGCCCCAGCATGC GGCCTCTGTTTGAT TTCTCCTGGCTGTC TCTGAAGACTCTGC TCAGTTTGGCCCTG GTGGGAGCTTGCAT CACCCTGGGTGCCT AT (SEQ ID NO: 2377) | TCTTCAGAGACA GCCAGGAGAAAT CAAACAGAGGCC GCATGCTGGGGC CG (SEQ ID NO: 2378) | AGGGTGATGCAA GCTCCCACCAGG GCCAAACTGAGC AGAG (SEQ ID NO: 2379) |
| CCND1_2 | NCI_Lih_1_030.1 | TGCTAATTTAAAGA GACTCCAAATCTCA ATGAAGCCAGCTCA CAGTGCTGTGTGCC CCGGTCACCTAGCA AGCTGCCGAACCA AAAGAATTTGCACC CCG (SEQ ID NO: 2380) | CAGCACTGTGAG CTGGCTTCATTGA GATTTGGAGTCTC TTTAAATTAGCA (SEQ ID NO: 2381) | TGCAAATTCTTT TGGTTCGGCAGC TTGCTAGGTGAC CGGGGCACA (SEQ ID NO: 2382) |
| CCND1_3 | NCI_Lih_1_002.1 | CGCGCCGGTGTCCC CAGAGACCAGGCT GTGTCCCTCTTCTC TTCCCTGCGCCTGT GATGCTGGGCACTT CATCTGATCGGGGG CGTAGCATCATAGT AGT (SEQ ID NO: 2383) | CGCAGGGAAGAG AAGAGGGACACA GCCTGGTCTCTGG GGACACCG (SEQ ID NO: 2384) | ACTACTATGATG CTACGCCCCCGA TCAGATGAAGTG CCCAGCATCACA GG (SEQ ID NO: 2385) |
| CCND1_4 | NCI_Lih_1_005.1 | ATTGATTCAGCCTG TTTGGCGTTTCCCA GAGTCATCTGATTG GACAGGCATGGGT GCAAGGAAAATTA GGGTACTAACCTA AGTTCGGTTCCGAT GAAT (SEQ ID NO: 2386) | TGCCTGTCCAATC AGATGACTCTGG GAAACGCCAAAC AGGCTGAATCAA T (SEQ ID NO: 2387) | ATTCATCGGAAC CGAACTTAGGTT GAGTACCCTAAT TTTCCTTGCACC CA (SEQ ID NO: 2388) |
| CCND1_5 | NCI_Lih_1_029.1 | GTTGTGTGTGCAGG GAGGGCAGTTTTCT AATGGAATGGTTTG GGAATATCCATGTA CTTGTTTGCAAGCA GGACTTTGAGGCAA GTGTGGGCCACTGT GG (SEQ ID NO: 2389) | GATATTCCCAAA CCATTCCATTAGA AAACTGCCCTCCC TGCACACACAAC (SEQ ID NO: 2390) | CCACAGTGGCCC ACACTTGCCTCA AAGTCCTGCTTG CAAACAAGTACA TG (SEQ ID NO: 2391) |
| CCND1_6 | NCI_Lih_1_019.1 | TCATGGCTGAAGTC ACCTCTTGGTTACA GTAGCGTAGCGTGG CCGTGTGCATGTCC TTTGCGCCTGTGAC CACCACCCCAACAA ACCATCCAGTGACA AA (SEQ ID NO: 2392) | GCACACGGCCAC GCTACGCTACTGT AACCAAGAGGTG ACTTCAGCCATG A (SEQ ID NO: 2393) | CACTGGATGGTT TGTTGGGGTGGT GGTCACAGGCGC AAAGGACAT (SEQ ID NO: 2394) |
| CDKN2A_1 | NCI_Lih_1_018.1 | GCACTCACGCCCTA AGCGCACATTCATG | CGAGGCTCGCAA GAAATGCCCACA | TCCCTAGTTCAC AAAATGCTTGTC |

TABLE 1-continued

| Gene | GenBank Accession No. | Target Sequence | Capture Probe Sequence | Reporter Probe Sequence |
|---|---|---|---|---|
| | | TGGGCATTTCTTGC GAGCCTCGCAGCCT CCGGAAGCTGTCGA CTTCATGACAAGCA TTTTGTGAACTAGG GA (SEQ ID NO: 2395) | TGAATGTGCGCTT AGGGCGTGAGTG C (SEQ ID NO: 2396) | ATGAAGTCGACA GCTTCCGGAGGC TG (SEQ ID NO: 2397) |
| CDKN2A_2 | NCI_Lih_1_042.1 | AAAGATACCGCGG TCCCTCCAGAGGAT TTGAGGGACAGGG TCGGAGGGGGCTCT TCCGCCAGCACCGG AGGAAGAAAGAGG AGGGGCTGGCTGGT CACCA (SEQ ID NO: 2398) | CCCCCTCCGACCC TGTCCCTCAAATC CTCTGGAGG (SEQ ID NO: 2399) | CCCTCCTCTTTCT TCCTCCGGTGCT GGCGGAAGAG (SEQ ID NO: 2400) |

Gene expression signatures based on novel combinations of genes derived from the 800 gene array can be used to diagnose a patient as having activated B cell-like diffuse large B cell lymphoma (ABC DLBCL), germinal center B cell-like diffuse large B cell lymphoma (GCB DLBCL), primary mediastinal B cell lymphoma (PMBL), Burkitt lymphoma (BL), or mantle cell lymphoma (MCL). For example, a gene expression signature that can be used to diagnose a patient as having one of the aforementioned lymphoma types includes at least one, but preferably two or more of the genes set forth in Table 1 (e.g., 2, 5, 10, 50, 75, 100, 125, 150, 175, 200, 225, 250, 275, 300, 400, 500, 600, or 700 genes, or a range defined by any two of the foregoing values). Desirably, the gene expression signature that can be used to diagnose a patient as having ABC DLBCL, GCB DLBCL, PMBL, BL, or MCL includes 15-200 of the genes set forth in Table 1 (e.g., 15, 30, 50, 75, 100, 125, 150, 175, or 200 genes, or a range defined by any two of the foregoing values). In one embodiment, the gene expression signature used to diagnose a patient as having ABC DLBCL, GCB DLBCL, PMBL, BL, or MCL includes the genes set forth in Table 2, or a subset of the genes set forth in Table 2 (e.g., 10, 15, 30, 50, 75, 100, 125, 150, or 190 of the genes set forth in Table 2, or a range defined by any two of the foregoing values).

TABLE 2

| Gene | GenBank Accession No. |
|---|---|
| ACSL5 | NM_016234.3 |
| ADAM12 | NM_003474.4 |
| AHCYL2 | NM_001130723.2 |
| AHR | NM_001621.3 |
| AKAP2 | NM_001136562.2 |
| AKAP9 | NM_005751.3 |
| ALOX5 | NM_000698.2 |
| ANKRD13A | NM_033121.1 |
| ANTXR1 | NM_018153.3 |
| ARID3A | NM_005224.2 |
| ARID3B | NM_006465.2 |
| ASB13 | NM_024701.3 |
| ATXN7L2 | NM_153340.4 |
| AUH | NM_001698.2 |
| AUTS2 | NM_001127231.1 |
| BANK1 | NM_001083907.1 |
| BATF | NM_006399.3 |
| BCAT1 | NM_005504.4 |
| BCL2 | NM_053056.2 |
| BCL2A1 | NM_004049.2 |

TABLE 2-continued

| Gene | GenBank Accession No. |
|---|---|
| BCL2L10 | NM_020396.2 |
| BCL6 | NM_001706.2 |
| BIRC3 | NM_001165.3 |
| BPGM | NM_199186.1 |
| BPNT1 | NM_006085.4 |
| BSPRY | NM_017688.2 |
| BUB1B | NM_001211.4 |
| C10orf18 | NM_017782.3 |
| C13orf18 | NM_025113.2 |
| C3orf37 | NM_020187.2 |
| CALD1 | NM_033138.2 |
| CARD11 | NM_032415.2 |
| CCDC50 | NM_174908.3 |
| CCL17 | NM_002987.2 |
| CCND1 | NM_053056.2 |
| CCND2 | NM_001759.2 |
| CCR7 | NM_001838.2 |
| CD44 | NM_000610.3 |
| CDH11 | NM_001797.2 |
| CDK5RAP2 | NM_001011649.1 |
| CDK6 | NM_001259.5 |
| CFLAR | NM_003879.3 |
| CGNL1 | NM_032866.3 |
| CHD4 | NM_001273.2 |
| CLIP2 | NM_003388.4 |
| CPA6 | NM_001127445.1 |
| CPNE3 | NM_003909.2 |
| CR2 | NM_001006658.1 |
| CREB3L2 | NM_194071.2 |
| CSF2RA | NM_006140.3 |
| CSTA | NM_005213.3 |
| CTHRC1 | NM_138455.2 |
| CTSH | NM_148979.2 |
| CTSK | NM_000396.2 |
| CYB5R2 | NM_016229.3 |
| CYP27A1 | NM_000784.3 |
| DAZAP2 | NM_014764.3 |
| DCTD | NM_001012732.1 |
| DENND4A | NM_005848.3 |
| DNAJB12 | NM_017626.4 |
| DNAJC10 | NM_018981.1 |
| DOCK10 | NM_014689.1 |
| DPYSL3 | NM_001387.2 |
| E2F2 | NM_004091.2 |
| EEPD1 | NM_030636.2 |
| EFEMP2 | NM_016938.3 |
| ELL2 | NM_012081.5 |
| EML1 | NM_004434.2 |
| ENTPD1 | NM_001776.4 |
| ERBB2IP | NM_018695.2 |
| ERP29 | NM_001034025.1 |
| ETV6 | NM_001987.4 |

TABLE 2-continued

| Gene | GenBank Accession No. |
|---|---|
| FAM108C1 | NM_021214.1 |
| FAM159A | NM_001042693.1 |
| FAM171B | NM_177454.3 |
| FAM46C | NM_017709.3 |
| FAM69A | NM_001006605.3 |
| FAP | NM_004460.2 |
| FAS | NM_000043.3 |
| FBXO41 | NM_001080410.1 |
| FCER2 | NM_002002.4 |
| FKBP11 | NM_016594.2 |
| FLJ42418 | NM_001001695.1 |
| FN1 | NM_212482.1 |
| FNDC1 | NM_032532.2 |
| FUT8 | NM_004480.3 |
| GCET2 | NM_001008756.1 |
| GIT2 | NM_057169.2 |
| GNA13 | NM_006572.4 |
| GNL3 | NM_014366.4 |
| GORASP1 | NM_031899.2 |
| GSK3B | NM_002093.2 |
| GYPC | NM_016815.2 |
| HARBI1 | NM_173811.3 |
| HCK | NM_002110.2 |
| HDAC1 | NM_004964.2 |
| HDGF | NM_004494.2 |
| HEG1 | NM_020733.1 |
| HLA-DMA | NM_006120.3 |
| HOMER2 | NM_004839.2 |
| HOPX | NM_001145460.1 |
| HPCAL1 | NM_134421.1 |
| HSP90AA1 | NM_005348.3 |
| HSP90B1 | NM_003299.1 |
| HSPA9 | NM_004134.4 |
| HSPB8 | NM_014365.2 |
| HTRA1 | NM_002775.4 |
| ICAM1 | NM_000201.1 |
| IFIH1 | NM_022168.2 |
| IGSF3 | NM_001542.2 |
| IK | NM_006083.3 |
| IL12A | NM_000882.2 |
| IL13RA1 | NM_001560.2 |
| IL16 | NM_004513.4 |
| IL17RB | NM_018725.3 |
| IRF4 | NM_002460.1 |
| ISG15 | NM_005101.3 |
| ISY1 | NM_020701.2 |
| ITGAV | NM_002210.2 |
| ITGAX | NM_000887.3 |
| ITGB2 | NM_000211.2 |
| 1TPKB | NM_002221.3 |
| JAK2 | NM_004972.2 |
| JAK3 | NM_000215.2 |
| KCNK12 | NM_022055.1 |
| KIAA0746 | NM_015187.3 |
| KIAA1274 | NM_014431.2 |
| KLHL5 | NM_015990.4 |
| KRAS | NM_033360.2 |
| KYNU | NM_003937.2 |
| LANCL1 | NM_006055.1 |
| LDHA | NM_005566.1 |
| LIMA1 | NM_001113547.1 |
| LIMD1 | NM_014240.2 |
| LMO2 | NM_005574.3 |
| LRMP | NM_006152.2 |
| LRRC15 | NM_001135057.2 |
| LRRC33 | NM_198565.1 |
| LTBP2 | NM_000428.2 |
| LYPD6B | NM_177964.3 |
| LYZ | NM_000239.2 |
| MAL | NM_002371.2 |
| MAML3 | NM_018717.4 |
| MAP3K1 | NM_005921.1 |
| MAP4K4 | NM_004834.3 |
| MAPK10 | NM_002753.2 |
| MARCKSL1 | NM_023009.5 |
| MAST2 | NM_015112.1 |
| MDFIC | NM_199072.2 |
| MLL2 | NM_003482.3 |
| MLLT10 | NM_004641.2 |
| MME | NM_000902.2 |
| MMP2 | NM_004530.2 |
| MMP9 | NM_004994.2 |
| MOBKL2C | NM_145279.4 |
| MPEG1 | XM_937323.1 |
| MTHFD2 | NM_006636.3 |
| MYB | NM_005375.2 |
| MYBL1 | XM_034274.14 |
| MYC | NM_002467.3 |
| NAIF1 | NM_197956.3 |
| NANS | NM_018946.3 |
| NCF2 | NM_000433.2 |
| NECAP2 | NM_018090.4 |
| NEIL1 | NM_024608.2 |
| NEK6 | NM_014397.3 |
| NEU3 | NM_006656.5 |
| NFIL3 | NM_005384.2 |
| NFKBIZ | NM_01005474.1 |
| NEPA2 | NM_001008860.1 |
| NOC3L | NM_022451.9 |
| NOL5A | NM_006392.2 |
| NP | NM_000270.3 |
| OPA1 | NM_130837.1 |
| OSBPL3 | NM_145320.1 |
| PAG1 | NM_018440.3 |
| PDE9A | NM_001001567.1 |
| PDIA5 | NM_006810.2 |
| PDLIM1 | NM_020992.2 |
| PDPN | NM_006474.4 |
| PFTK1 | NM_012395.2 |
| PHF16 | NM_014735.3 |
| PHF23 | NM_024297.2 |
| PIM1 | NM_002648.2 |
| PIM2 | NM_006875.2 |
| PLAU | NM_002658.2 |
| PLEK | NM_002664.2 |
| PLEKHF2 | NM_024613.2 |
| PMEPA1 | NM_020182.3 |
| PPA1 | NM_021129.3 |
| PPP3CC | NM_005605.3 |
| PRDX2 | NM_005809.4 |
| PRICKLE1 | NM_153026.1 |
| PRKCB | NM_212535.1 |
| PRPSAP2 | NM_002767.2 |
| PRR6 | NM_181716.2 |
| PTGIR | NM_000960.3 |
| PTK2 | NM_005607.3 |
| PTPN1 | NM_002827.2 |
| PTRH1 | NM_001002913.1 |
| R3HDM1 | NM_015361.2 |
| RAB20 | NM_017817.1 |
| RAB33A | NM_004794.2 |
| RAB7L1 | NM_001135664.1 |
| RANBP9 | NM_005493.2 |
| RAPGEF5 | NM_012294.3 |
| RARRES2 | NM_002889.3 |
| RASGRP3 | NM_015376.2 |
| RC3H2 | NM_018835.2 |
| RCL1 | NM_005772.3 |
| REL | NM_002908.2 |
| RFTN1 | NM_015150.1 |
| RGS9 | NM_003835.1 |
| RHOF | NM_019034.2 |
| RNF214 | NM_207343.2 |
| RNUXA | NM_032177.3 |
| ROBO1 | NM_002941.2 |
| RRP1B | NM_015056.2 |
| S100Z | NM_130772.3 |
| S1PR2 | NM_004230.2 |
| SACS | NM_014363.4 |
| SAMSN1 | NM_022136.3 |
| SCARA5 | NM_173833.4 |
| SERPINA9 | NM_001042518.1 |
| SGK1 | NM_005627.2 |
| SH3BP5 | NM_001018009.2 |

TABLE 2-continued

| Gene | GenBank Accession No. |
|---|---|
| SIDT1 | NM_017699.2 |
| SLA | NM_001045556.2 |
| SLAMF1 | NM_003037.2 |
| SLC38A5 | NM_033518.2 |
| SMARCA4 | NM_003072.3 |
| SNN | NM_003498.4 |
| SNX11 | NM_152244.1 |
| SNX22 | NM_024798.2 |
| SNX29 | NM_001080530.2 |
| SOX11 | NM_003108.3 |
| SPARC | NM_003118.2 |
| SPINK2 | NM_021114.2 |
| SPINT2 | NM_021102.2 |
| SPRED2 | NM_181784.2 |
| SSBP2 | NM_012446.2 |
| STAMBPL1 | NM_020799.2 |
| STAP1 | NM_012108.2 |
| STAT3 | NM_139276.2 |
| STK17A | NM_004760.1 |
| STS | NM_000351.4 |
| STX11 | NM_003764.3 |
| SUFU | NM_016169.2 |
| SULF1 | NM_015170.2 |
| TARS | NM_152295.3 |
| TBC1D9 | NM_015130.2 |
| TCF3 | NM_003200.2 |
| TCF4 | NM_001083962.1 |
| TCTN3 | NM_0115631.5 |
| TERT | NM_198253.1 |
| TEX9 | NM_198524.1 |
| THBS2 | NM_003247.2 |
| THOC5 | NM_001002878.1 |
| THY1 | NM_006288.2 |
| TIAM2 | NM_001010927.2 |
| TICAM2 | NM_021649.4 |
| TLE4 | NM_007005.3 |
| TLK1 | NM_012290.3 |
| TLR7 | NM_016562.3 |
| TMEM119 | NM_181724.2 |
| TMOD1 | NM_003275.2 |
| TNFRSF13B | NM_012452.2 |
| TNFRSF17 | NM_001192.2 |
| TNFSF4 | NM_003326.2 |
| TOX | NM_014729.2 |
| TPM1 | NM_000366.5 |
| TRAF1 | NM_005658.3 |
| TRIM56 | NM_030961.1 |
| TRM62 | NM_018207.2 |
| TRIP13 | NM_004237.2 |
| TTC9 | NM_015351.1 |
| TUBB2C | NM_006088.5 |
| UBXN4 | NM_014607.3 |
| USP12 | NM_182488.3 |
| USP46 | NM_022832.2 |
| VAC14 | NM_018052.3 |
| VASH2 | NM_024749.3 |
| VGLL4 | NM_001128220.1 |
| VRK3 | NM_016440.3 |
| WAC | NM_100486.2 |
| WDR55 | NM_017706.4 |
| WNT3 | NM_030753.3 |
| XBP1 | NM_005080.2 |
| ZBTB32 | NM_014383.1 |
| ZBTB37 | NM_001122770.1 |
| ZBTB8 | NM_001040441.1 |
| ZCCHC2 | NM_017742.4 |
| ZCCHC7 | NM_032226.2 |
| ZNF281 | NM_012482.3 |
| ZNF318 | NM_014345.2 |
| ZNF598 | NM_178167.2 |
| ZNF608 | NM_020747.2 |

The invention also provides a method for selecting a treatment option for a subject who already has been diagnosed with a diffuse large B cell lymphoma (DLBCL). The method comprises isolating a gene expression product from a biopsy sample from a DLBCL subject, and obtaining digital gene expression data from the isolated gene expression product. The method comprises isolating a gene expression product from a biopsy sample from a DLBCL subject, and obtaining digital gene expression data from the isolated gene expression product. Descriptions of the gene expression product, digital gene expression data, and gene expression signature set forth above in connection with other embodiments of the invention also are applicable to those same aspects of the aforesaid inventive method for selecting a treatment option for a subject who already has been diagnosed with a DLBCL.

The invention further provides a method for selecting a GCB DLBCL subject for treatment with R-CHOP (rituxan, cyclophosphamide, hydroxydaunorubicin, oncovin (vincristine), and prednisone) therapy. The method comprises (a) isolating a gene expression product from a biopsy sample from a DLBCL subject; (b) obtaining digital gene expression data from the isolated gene expression product, wherein the digital gene expression data comprises data for genes in a gene expression signature (c) generating a weighted average of the expression levels of genes from the gene expression signature to thereby obtain a gene expression signature value; (d) calculating a predictor score based on the gene expression signature value; (e) classifying the subject as belonging to ABC DLBCL or GCB DLBCL based on the predictor score of (d); (f) selecting a GCB DLBCL subject for R-CHOP therapy; and (g) providing R-CHOP therapy to the GCB DLBCL subject and providing a different therapy to an ABC DLBCL subject. Descriptions of the gene expression product, digital gene expression data, and gene expression signature set forth above in connection with other embodiments of the invention also are applicable to those same aspects of the aforesaid inventive method for selecting a GCB DLBCL subject for treatment with R-CHOP therapy.

The invention provides gene expression signatures that can be used to classify a DLBCL as belonging to the GCB subtype or the ABC subtype and then select an appropriate treatment option based on that classification. In this respect, the invention provides a novel 20 gene array for the identification and diagnosis of various lymphoma types. The 20 gene array contains 15 genes of interest and 5 housekeeping genes, and is based on a pilot study described in Lenz et al., N. Engl. J. Med., 359: 2313-2323 (2008) (see also the Example herein). The genes and probe sequences that comprise the 20 gene array are set forth in Table 3. Gene expression signatures based on all or combinations of the genes from the 20 gene array can be used to diagnose a patient has having ABC DLBCL or GCB DLBCL. For example, a gene expression signature that can be used to diagnose a patient as having ABC DLBCL or GCB DLBCL includes at least one, but preferably two or more (e.g., 2, 3, 4, 5, 6, 7, 8, 9, 10, 11, 12, 13, 14, 15, 16, 17, 18, 19, or 20) of the genes set forth in Table 3.

TABLE 3

| Gene | GenBank Accession No. | Target Sequence | Capture Probe Sequence | Reporter Probe Sequence |
|---|---|---|---|---|
| ASB13 | NM_024701.3 | GGACACGTAGGCGGTACCACTAAGGTTTTGGTAATGAGCCATTCAAACCGACAGCAGTGTGAAGGTGTGTCAAGGTGTATATTCTCGTGGCTCGGCATTC (SEQ ID NO: 2401) | CGGTTTGAATGGCTCATTACCAAACCTTAGTGGTACCGCCTACGTGTCC (SEQ ID NO: 2402) | GAATGCCGAGCCACGAGAATATACACCTTGACACACCTTCACACTGCTGT (SEQ ID NO: 2403) |
| CCDC50 | NM_174908.3 | AAACACTTTCCAGAGTTCCCTGCAACCCGTGCTTATGCAGATAGTTACTATTATGAAGATGGAGGAATGAAGCCAAGAGTGATGAAAGAAGCTGTATCTA (SEQ ID NO: 2404) | TAGTAACTATCTGCATAAGCACGGGTTGCAGGGAACTCTGGAAAGTGTTT (SEQ ID NO: 2405) | TAGATACAGCTTCTTICATCACTCYTGGCTTCATTCCTCCATCTTCATAA (SEQ ID NO: 2406) |
| CREB3L2 | NM_194071.2 | ATGCCTGAGGGGATCAGGCTTTTCTACTCCAGGCAAACCTGCCCCATCTTGTCGCTTTTAGGACCTCCCACAACCTGGTTCCCCACACATCCATAGTTCT (SEQ ID NO: 2407) | AAGATGGGGCAGGTTTGCCTGGAGTAGAAAAGCCTGATCCCCT (SEQ ID NO: 2408) | AGAACTATGGATGTGTGGGGAACCAGGTTGTGGGAGGTCCTAAAAGCGAC (SEQ ID NO: 2409) |
| CYB5R2 | NM_016229.3 | CCATGTCTTAGGGCTTCCTGTAGGTAACTATGTCCAGCTCTTGGCAAAAATCGATAATGAATTGGTGGTCAGGGCTTACACCCCTGTCTCCAGTGATGAT (SEQ ID NO: 2410) | TTTTTGCCAAGAGCTGGACATAGTTACCTACAGGAAGCCCTAAGACATGG (SEQ ID NO: 2411) | ATCATCACTGGAGACAGGGGTGTAAGCCCTGACCACCAATTCATTATCGA (SEQ ID NO: 2412) |
| IRF4 | NM_002460.1 | GGGCACTGTTTAAAGGAAAGTTCCGAGAAGGCATCGACAAGCCGGACCCTCCCACCTGGAAGACGCGCCTGCGGTGCGCTTTGAACAAGAGCAATGACTT (SEQ ID NO: 2413) | AGGGTCCGGCTTGTCGATGCCTTCTCGGAACTTTCCTTTAAACAGTGCCC (SEQ ID NO: 2414) | TTGTTCAAAGCGCACCGCAGGCGCGTCTTCCAGGTGGG (SEQ ID NO: 2415) |
| ISY1 | NM_020701.2 | GGCAAAACATCAGTGTCTGTGGGTAGTTGGAATCTTCAGTTCCTGTGAGCGTCGGCGTCTTCTGGGCCTGTGGAGTTTCTTGGACAGGGGCCGCGGGGCT (SEQ ID NO: 2416) | GCTCACAGGAACTGAAGATTCCAACTACCCACAGACACTGATGTTTTGCC (SEQ ID NO: 2417) | CCCCTGTCCAAGAAACTCCACAGGCCCAGAAGACGCCGAC (SEQ ID NO: 2418) |
| ITPKB | NM_002221.3 | GTGGCCTCCTGGCATCATTTGTTATTGCCTCTGAAACAAGCCTTACTGCCTGGAGGGCTTAGATTCCTGCTTCTCCAATGTAGTGTGGGTATCTTGTAGG (SEQ ID NO: 2419) | GGCAGTAAGGCTTGTTTCAGAGGCAATAACAAATGATGCCAGGAGGCCAC (SEQ ID NO: 2420) | CCTACAAGATACCCACACTACATTGGAGAAGCAGGAATCTAAGCCCTCCA (SEQ ID NO: 2421) |
| LIMD1 | NM_014240.2 | AAGGCAAGTCTCAGGAACCCATGCAGGTACATCGCTTGCACCTGTTTTTAGCTTATTTAATGACGGGCTTTTGGGAAGAGCTGCCCGCATACTGAGAGAC (SEQ ID NO: 2422) | TAAAAACAGGTGCAAGCGATGTACCTGCATGGGTTCCTGAGACTTGCCTT (SEQ ID NO: 2423) | TCTCTCAGTATGCGGGCAGCTCTTCCCAAAAGCCCGTCATTAAATAAGC (SEQ ID NO: 2424) |

TABLE 3-continued

| Gene | GenBank Accession No. | Target Sequence | Capture Probe Sequence | Reporter Probe Sequence |
|---|---|---|---|---|
| MAML3 | NM_018717.4 | TGGAAGCCATCAACAATTTGCCCAGTAACATGCCACTGCCTTCAGCTTCTCCTCTTCACCAACTTGACCTGAAACCTTCTTTGCCCTTGCAGAACAGTGG (SEQ ID NO: 2425) | AGAAGCTGAAGGCAGTGGCATGTTACTGGGCAAATTGTTGATGGCTTCCA (SEQ ID NO: 2426) | CCACTGTTCTGCAAGGGCAAAGAAGGTTTCAGGTCAAGTTGGTGAAGAGG (SEQ ID NO: 2427) |
| MME | NM_000902.2 | GGATTGTAGGTGCAAGCTGTCCAGAGAAAAGAGTCCTTGTTCCAGCCCTATTCTGCCACTCCTGACAGGGTGACCTTGGGTATTTGCAATATTCCTTTGG (SEQ ID NO: 2428) | TAGGGCTGGAACAAGGACTCTTTTCTCTGGACAGCTTGCACCTACAATCC (SEQ ID NO: 2429) | CCAAAGGAATATTGCAAATACCCAAGGTCACCCTGTCAGGAGTGGCAGAA (SEQ ID NO: 2430) |
| MYBL1 | XM_034274.14 | GGCAAACGCTGTGTTATCCTCTTTGCAGACCATCCCAGAATTTGCAGAGACTCTAGAACTTATTGAATCTGATCCTGTAGCATGGAGTGACGTTACCAGT (SEQ ID NO: 2431) | TCTCTGCAAATTCTGGGATGGTCTGCAAAGAGGATAACACAGCGTTTGCC (SEQ ID NO: 2432) | ACTGGTAACGTCACTCCATGCTACAGGATCAGATTCAATAAGTTCTAGAG (SEQ ID NO: 2433) |
| PIM2 | NM_006875.2 | GCCATCCAGCACTGCCATTCCCGTGGAGTTGTCCATCGTGACATCAAGGATGAGAACATCCTGATAGACCTACGCCGTGGCTGTGCCAAACTCATTGATT (SEQ ID NO: 2434) | TCCTTGATGTCACGATGGACAACTCCACGGGAATGGCAGTGCTGGATG (SEQ ID NO: 2435) | AATCAATGAGTTTGGCACAGCCACGGCGTAGGTCTATCAGGATGTTCTCA (SEQ ID NO: 2436) |
| R3HDM1 | NM_015361.2 | CCTGTGTTCCCAAGAGAATTACATTATTGACAAAAGACTCCAAGACGAGGATGCCAGTAGTACCCAGCAGAGGCGCCAGATATTTAGAGTTAATAAAGAT (SEQ ID NO: 2437) | CCTCGTCTTGGAGTCTTTTGTCAATAATGTAATTCTCTTGGGAACACAGG (SEQ ID NO: 2438) | ATCTTTATTAACTCTAAATATCGGCGCCTCTGCTGGGTACTACTGGCAT (SEQ ID NO: 2439) |
| RAB7L1 | NM_001135664.1 | CATTTGAATTGTCTCCTGACTACTGTCCAGTAAGGAGGCCCATTGTCACTTAGAAAAGACACCTGGAACCCATGTCATTTCTGCATCTCCTGGATTAGC (SEQ ID NO: 2440) | AGTGACAATGGGCCTCCTTACTGGACAGTAGTCAGGAGACAATTCAAATG (SEQ ID NO: 2441) | CTAATCCAGGAGATGCAGAAATGCACATGGGTTCCAGGTGTCTTTTCTA (SEQ ID NO: 2442) |
| S1PR2 | NM_004230.2 | TCCCGCCAGGTGGCCTCGGCCTTCATCGTCATCCTCTGTTGCGCCATTGTGGTGGAAAACCTTCTGGTGCTCATTGCGGTGGCCCGAAACAGCAAGTTCC (SEQ ID NO: 2443) | ACAATGGCGCAACAGAGGATGACGATGAAGGCCGAGGCCACCTGG (SEQ ID NO: 2444) | GGAACTTGCTGTTTCGGGCCACCGCAATGAGCACCAGAAGGTTTTCCACC (SEQ ID NO: 2445) |
| SERPINA9 | NM_001042518.1 | CCACTAAATCCTAGGTGGGAAATGGCCTGTTAACTGATGGCACATTGCTAATGCACAAGAAATAACAAACCACATCCCTCTTTCTGTTCTGAGGGTGCAT (SEQ ID NO: 2446) | TAGCAATGTGCCATCAGTTAACAGGCCATTTCCCACCTAGGATTTAG (SEQ ID NO: 2447) | ATGCACCCTCAGAACAGAAAGAGGGATGTGGTTTGTTATTTCTTGTGCAT (SEQ ID NO: 2448) |

TABLE 3-continued

| Gene | GenBank Accession No. | Target Sequence | Capture Probe Sequence | Reporter Probe Sequence |
|---|---|---|---|---|
| TNFRSF13B | NM_012452.2 | TGCAAAACCATTTGC AACCATCAGAGCCAG CGCACCTGTGCAGCC TTCTGCAGGTCACTC AGCTGCCGCAAGGAG CAAGGCAAGTTCTAT GACCATCTCC (SEQ ID NO: 2449) | CAGAAGGCTGCAC AGGTGCGCTGGCT CTGATGGTTGCAA ATGGTTTTGCA (SEQ ID NO: 2450) | TCATAGAACTTGC CTTGCTCCTTGCG GCAGCTGAGTGA CCTG (SEQ ID NO: 2451) |
| TRIM56 | NM_030961.1 | GTGGAGGCCGAGGAC ATTTTCCTGAAGGGC AGGGGTTGGCAACTT TTCAACATGGAGTGC CAAACTGCTAACCCG TCTTCTAGTGTGTGA GAATAGGGAC (SEQ ID NO: 2452) | TTGAAAAGTTGCC AACCCCTGCCCTT CAGGAAAATGTCC TCGGCCT (SEQ ID NO: 2453) | CCTATTCTCACAC ACTAGAAGACGG GTTAGCAGTTTGG CACTCCATG (SEQ ID NO: 2454) |
| UBXN4 | NM_014607.3 | CATCGCGACGGCCAA AAGGAGCGGCGCGGT CTTCGTGGTGTTCGTG GCAGGTGATGATGAA CAGTCTACACAGATG GCTGCAAGTTGGGAA GATGATAAA (SEQ ID NO: 2455) | CTGCCACGAACAC CACGAAGACCGCG CCGCTCCTTTTGGC CG (SEQ ID NO: 2456) | TTTATCATCTTCC CAACTTGCAGCC ATCTGTGTAGACT GTTCATCATCAC (SEQ ID NO: 2457) |
| WDR55 | NM_017706.4 | CTACCTCTTCAATTGG AATGGCTTTGGGGCC ACAAGTGACCGCTTT GCCCTGAGAGCTGAA TCTATCGACTGCATG GTTCCAGTCACCGAG AGTCTGCTG (SEQ ID NO: 2458) | GGGCAAAGCGGTC ACTTGTGGCCCCA AAGCCATTCCAAT TGAAGAG (SEQ ID NO: 2459) | GACTCTCGGTGA CTGGAACCATGC AGTCGATAGATT CAGCTCTCA (SEQ ID NO: 2460) |

In one embodiment, a method used to evaluate the likelihood that a particular sample belongs to ABC DLBCL, GCB DLBCL, PMBL, BL, or MCL involves (1) normalizing and transforming gene expression data from the gene expression signature and performing quality control, (2) forming individual trinary submodels, and (3) combining submodels into a final prediction. The gene expression data can be transformed by associating with each probe set a value equal to $\log_2$ of the counts reported for that probe set. A weighted average of the expression levels of genes from the gene expression signature can then be generated by multiplying the transformed data by their respective normalization weights (as set forth in Table 4) and summed to arrive at a normalization factor. If the normalization factor is less than 4.5, the sample is excluded as being of poor quality. Otherwise, the normalization factor can be subtracted from each of the log transformed data counts. If a reference array for the chip batch and a reference gold standard array are available, then for each probe set the $\log_2$ of the score for the reference array counts for that gene is subtracted and the $\log_2$ of the gold standard counts for that gene is added. These aforementioned steps are summarized in the following equation, which calculates a predictor score $y_i$ (the final output signal used for probe set i):

$$y_i = \log_2(x_i) - \sum_j \log_2(x_j) h_j - \log_2(r_i) + \log_2(g_i)$$

wherein $x_i$ is the counts for probe set i on the array of the sample being tested, $h_j$ is the housekeeping weight for probe set j, $r_i$ is the counts for probe set i on the reference array, and $g_i$ is the counts for probe set i on the gold-standard array.

The final classification of the subject as belonging to (i) ABC DLBCL, (ii) GCB DLBCL, (iii) PMBL, (iv) BL, or (v) MCL is based on a combination of five trinary submodels for each lymphoma type (i.e., MCL, BL non-myc, BL myc, PMBL, ABC DLBCL, and GCB DLBCL), each of which produces three possible output values (i.e., −1,0,1) according to the following formula:

$$\text{Submodel call} = \begin{cases} -1 & \text{if } \sum_i y_i w_i \leq \text{Lower } cutpoint \\ 0 & \text{Lower } cutpoint < \sum_i y_i w_i < \text{Upper } cutpoint \\ 1 & \sum_i y_i w_i \geq \text{Upper } cutpoint \end{cases}$$

wherein $y_i$ is the predictor score $y_i$ assigned to probe set i as described above, $w_i$ are the weights associated with that probe set for the particular model as presented in Table 4, and the upper and lower cutpoints for a particular submodel are set forth in Table 5.

TABLE 4

| Gene | Normalization weights | ABC/GCB weights | BL non-Myc weights | BL myc weights | PMBL Weights | MCL Weights |
|---|---|---|---|---|---|---|
| ACPP | 0 | 0 | 0 | 0 | 0 | 0 |
| ACTG2 | 0 | 0 | 0 | 0 | 0 | 0 |
| ADAM12 | 0 | 0 | 0 | 0 | −2.166433184 | 0 |
| ADAM28 | 0 | 0 | 0 | 0 | 0 | 0 |
| ADH1B | 0 | 0 | 0 | 0 | 0 | 0 |
| ADIPOQ | 0 | 0 | 0 | 0 | 0 | 0 |
| ADO | 0 | 0 | 0 | 0 | 0 | 0 |
| AHR | 0 | 0 | 0 | −4.866117918 | 0 | 0 |
| AICDA | 0 | 0 | 0 | 0 | 0 | 0 |
| AKAP2 | 0 | 0 | 0 | 0 | 19.33144328 | 0 |
| AKR1C2 | 0 | 0 | 0 | 0 | 0 | 0 |
| ALOX5 | 0 | −11.14191131 | 0 | 0 | 0 | 59.14375571 |
| AMIGO2 | 0 | 0 | 0 | 0 | 0 | 0 |
| ANKRD13A | 0 | −13.1144441 | 0 | 0 | 0 | 0 |
| ANLN | 0 | 0 | 0 | 0 | 0 | 0 |
| ANO3 | 0 | 0 | 0 | 0 | 0 | 0 |
| ANTXR1 | 0 | 0 | 0 | 0 | −2.443912822 | 0 |
| ANUBL1 | 0 | 0 | 0 | 0 | 0 | 0 |
| APOL1 | 0 | 0 | 0 | 0 | 0 | 0 |
| ARID3A | 0 | 16.99118469 | 0 | 0 | 0 | 0 |
| ARID3B | 0 | 12.66080868 | 0 | 0 | 0 | 0 |
| ARID5A | 0 | 0 | 0 | 0 | 0 | 0 |
| ARL6IP1 | 0 | 0 | 0 | 0 | 0 | 0 |
| ARNT2 | 0 | 0 | 0 | 0 | 0 | 0 |
| ARNTL | 0 | 0 | 0 | 0 | 0 | 0 |
| ASB13 | 0 | −19.64578147 | 0 | 0 | 0 | 0 |
| ASPM | 0 | 0 | 0 | 0 | 0 | 0 |
| ATF3 | 0 | 0 | 0 | 0 | 0 | 0 |
| ATM | 0 | 0 | 0 | 0 | 0 | 0 |
| ATP6V0E1 | 0 | 0 | 0 | 0 | 0 | 0 |
| AUH | 0 | 0 | 0 | 0 | 20.46302485 | 0 |
| AURKA | 0 | 0 | 0 | 0 | 0 | 0 |
| AUTS2 | 0 | −15.20513307 | 0 | 0 | 0 | 0 |
| BANK1 | 0 | 0 | 0 | 0 | −24.53325693 | 0 |
| BASP1 | 0 | 0 | 0 | 0 | 0 | 0 |
| BATF | 0 | 17.98245577 | 0 | 0 | 0 | 0 |
| BATF3 | 0 | 0 | 0 | 0 | 0 | 0 |
| BCAT1 | 0 | 0 | 0 | 0 | 0 | −74.11099391 |
| BCL10 | 0 | 0 | 0 | 0 | 0 | 0 |
| BCL2 | 0 | 0 | 0 | 0 | 0 | 0 |
| BCL2 | 0 | 0 | 0 | 0 | 0 | 0 |
| BCL2 | 0 | 0 | 0 | 0 | 0 | 0 |
| BCL2 | 0 | 0 | 0 | 0 | 0 | 0 |
| BCL2 | 0 | 14.07216258 | 0 | 0 | 0 | 0 |
| BCL2 | 0 | 0 | 0 | 0 | 0 | 0 |
| BCL2A1 | 0 | 0 | 0 | −5.947560928 | 0 | 0 |
| BCL2L10 | 0 | 9.91380548 | 0 | 0 | 0 | 0 |
| BCL6 | 0 | −17.29479012 | 0 | −5.383296889 | 0 | 0 |
| BEST3 | 0 | 0 | 0 | 0 | 0 | 0 |
| BIRC2 | 0 | 0 | 0 | 0 | 0 | 0 |
| BIRC3 | 0 | 0 | 0 | −5.663158028 | 0 | 0 |
| BIRC5 | 0 | 0 | 0 | 0 | 0 | 0 |
| BMP7 | 0 | 0 | 0 | 0 | 0 | 0 |
| BPGM | 0 | 10.51166906 | 0 | 0 | 0 | 0 |
| BPNT1 | 0 | −11.94204992 | 0 | 0 | 0 | 0 |
| BSPRY | 0 | 12.55890968 | 0 | 0 | 0 | 0 |
| BST2 | 0 | 0 | 0 | 0 | 0 | 0 |
| BTBD19 | 0 | 0 | 0 | 0 | 0 | 0 |
| BTG1 | 0 | 0 | 0 | 0 | 0 | 0 |
| BTG2 | 0 | 0 | 0 | 0 | 0 | 0 |
| BTK | 0 | 0 | 0 | 0 | 0 | 0 |
| BUB1 | 0 | 0 | 0 | 0 | 0 | 0 |
| BUB1B | 0 | 0 | 0.129449175 | −6.543666003 | 0 | 0 |
| C10orf18 | 0 | −11.23438924 | 0 | 0 | 0 | 0 |
| C13orf18 | 0 | 14.60869443 | 0 | 6.676459404 | 0 | 0 |
| C15orf41 | 0 | 0 | 0 | 0 | 0 | 0 |
| C3orf37 | 0 | −13.2892376 | 0 | 0 | 0 | 0 |
| C5AR1 | 0 | 0 | 0 | 0 | 0 | 0 |
| C5orf41 | 0 | 0 | 0 | 0 | 0 | 0 |
| C7orf68 | 0 | 0 | 0 | 0 | 0 | 0 |
| CACNA1D | 0 | 0 | 0 | 0 | 0 | 0 |
| CALD1 | 0 | 0 | 0 | 0 | −2.249574505 | 0 |
| CAMK2B | 0 | 0 | 0 | 0 | 0 | 0 |
| CARD11 | 0 | 13.81862222 | 0 | 0 | −18.72040556 | 0 |
| CAV1 | 0 | 0 | 0 | 0 | 0 | 0 |
| CAV2 | 0 | 0 | 0 | 0 | 0 | 0 |
| CCDC50 | 0 | 18.68358953 | 0 | 5.320661402 | 0 | 68.6051667 |

TABLE 4-continued

| Gene | Normalization weights | ABC/GCB weights | BL non-Myc weights | BL myc weights | PMBL Weights | MCL Weights |
|---|---|---|---|---|---|---|
| CCDC75 | 0 | 0 | 0 | 0 | 0 | 0 |
| CCL17 | 0 | 0 | 0 | 0 | 25.50999568 | 0 |
| CCNA2 | 0 | 0 | 0 | 0 | 0 | 0 |
| CCNB1 | 0 | 0 | 0 | 0 | 0 | 0 |
| CCNB2 | 0 | 0 | 0 | 0 | 0 | 0 |
| CCND1 | 0 | 0 | 0 | 0 | 0 | 0 |
| CCND1 | 0 | 0 | 0 | 0 | 0 | 0 |
| CCND1 | 0 | 0 | 0 | 0 | 0 | 0 |
| CCND1 | 0 | 0 | 0 | 0 | 0 | 0 |
| CCND1 | 0 | 0 | 0 | 0 | 0 | 0 |
| CCND1 | 0 | 0 | 0 | 0 | 0 | 87.99680321 |
| CCND2 | 0 | 13.55862157 | 0 | 0 | 0 | 0 |
| CCND3 | 0 | 0 | 0 | 0 | 0 | 0 |
| CCR7 | 0 | 11.22811168 | 0 | −4.862612697 | 0 | 0 |
| CD2 | 0 | 0 | 0 | 0 | 0 | 0 |
| CD200 | 0 | 0 | 0 | 0 | 0 | 0 |
| CD22 | 0 | 0 | 0 | 0 | 0 | 0 |
| CD247 | 0 | 0 | 0 | 0 | 0 | 0 |
| CD274 | 0 | 0 | 0 | 0 | 0 | 0 |
| CD3D | 0 | 0 | 0 | 0 | 0 | 0 |
| CD3E | 0 | 0 | 0 | 0 | 0 | 0 |
| CD3G | 0 | 0 | 0 | 0 | 0 | 0 |
| CD40 | 0 | 0 | 0 | 0 | 0 | 0 |
| CD44 | 0 | 13.50378135 | 0 | −5.782231847 | 0 | 0 |
| CD47 | 0 | 0 | 0 | 0 | 0 | 0 |
| CD5 | 0 | 0 | 0 | 0 | 0 | 0 |
| CD58 | 0 | 0 | 0 | 0 | 0 | 0 |
| CD6 | 0 | 0 | 0 | 0 | 0 | 0 |
| CD74 | 0 | 0 | 0 | 0 | 0 | 0 |
| CD79A | 0 | 0 | 0 | 0 | 0 | 0 |
| CD79B | 0 | 0 | 0 | 0 | 0 | 0 |
| CD8A | 0 | 0 | 0 | 0 | 0 | 0 |
| CD8B | 0 | 0 | 0 | 0 | 0 | 0 |
| CDC20 | 0 | 0 | 0 | 0 | 0 | 0 |
| CDC25B | 0 | 0 | 0 | 0 | 0 | 0 |
| CDC25C | 0 | 0 | 0 | 0 | 0 | 0 |
| CDCA3 | 0 | 0 | 0 | 0 | 0 | 0 |
| CDCA5 | 0 | 0 | 0 | 0 | 0 | 0 |
| CDCA8 | 0 | 0 | 0 | 0 | 0 | 0 |
| CDH11 | 0 | 0 | 0 | 0 | −2.338738276 | 0 |
| CDC2 | 0 | 0 | 0 | 0 | 0 | 0 |
| PFTK1 | 0 | −15.92270263 | 0 | 0 | 0 | 0 |
| CDK4 | 0 | 0 | 0 | 0 | 0 | 0 |
| CDK6 | 0 | 0 | 0 | 0 | 0 | −65.86959926 |
| CDKN2A | 0 | 0 | 0 | 0 | 0 | 0 |
| CDKN2A | 0 | 0 | 0 | 0 | 0 | 0 |
| CDKN3 | 0 | 0 | 0 | 0 | 0 | 0 |
| CELSR1 | 0 | 0 | 0 | 0 | 0 | 0 |
| CENPA | 0 | 0 | 0 | 0 | 0 | 0 |
| CENPE | 0 | 0 | 0 | 0 | 0 | 0 |
| CENPF | 0 | 0 | 0 | 0 | 0 | 0 |
| CENPN | 0 | 0 | 0 | 0 | 0 | 0 |
| PRR6 | 0 | 0 | 0 | 0 | 22.43680643 | 0 |
| CEP55 | 0 | 0 | 0 | 0 | 0 | 0 |
| CFLAR | 0 | 16.61287119 | 0 | −5.100315997 | 0 | 0 |
| CGNL1 | 0 | 0 | 0 | 0 | −2.156504887 | 0 |
| CIITA | 0 | 0 | 0 | 0 | 0 | 0 |
| CKS2 | 0 | 0 | 0 | 0 | 0 | 0 |
| CLIP2 | 0 | 0 | 0 | 0 | 20.2768953 | 0 |
| CLMN | 0 | 0 | 0 | 0 | 0 | 0 |
| CPNE3 | 0 | −11.49752906 | 0 | 0 | 0 | 0 |
| CR2 | 0 | −12.2225611 | 0 | −5.465732584 | −19.63179827 | 0 |
| CREB3L2 | 0 | 19.29029329 | 0 | 0 | 0 | 0 |
| CREBBP | 0 | 0 | 0 | 0 | 0 | 0 |
| CSF2RA | 0 | 0 | 0 | 0 | −2.424880636 | 0 |
| CSTA | 0 | 0 | 0 | 0 | −2.543864326 | 0 |
| CTGF | 0 | 0 | 0 | 0 | 0 | 0 |
| CTH | 0 | 0 | 0 | 0 | 0 | 0 |
| CTHRC1 | 0 | 0 | 0 | 0 | −2.518684898 | 0 |
| CTLA4 | 0 | 0 | 0 | 0 | 0 | 0 |
| CTNNA2 | 0 | 0 | 0 | 0 | 0 | 0 |
| CTPS | 0 | 0 | 0 | 0 | 0 | 0 |
| CTSH | 0 | 0 | 0 | −5.145507824 | 0 | 0 |
| CTSK | 0 | 0 | 0 | 0 | −2.572873829 | 0 |
| CXCL10 | 0 | 0 | 0 | 0 | 0 | 0 |
| CXCL12 | 0 | 0 | 0 | 0 | 0 | 0 |
| CXCL9 | 0 | 0 | 0 | 0 | 0 | 0 |

TABLE 4-continued

| Gene | Normalization weights | ABC/GCB weights | BL non-Myc weights | BL myc weights | PMBL Weights | MCL Weights |
|---|---|---|---|---|---|---|
| CYB5R2 | 0 | 19.12600362 | 0 | 0 | 0 | 0 |
| CYP27A1 | 0 | 0 | 0 | 0 | −2.635085165 | 0 |
| CYP2J2 | 0 | 0 | 0 | 0 | 0 | 0 |
| CYSLTR1 | 0 | 0 | 0 | 0 | 0 | 0 |
| DCBLD1 | 0 | 0 | 0 | 0 | 0 | 0 |
| DCTD | 0 | 15.98936135 | 0 | 0 | 0 | 0 |
| DDAH2 | 0 | 0 | 0 | 0 | 0 | 0 |
| DDX58 | 0 | 0 | 0 | 0 | 0 | 0 |
| DENND4A | 0 | 0 | 0 | 0 | 21.20254474 | 0 |
| DLC1 | 0 | 0 | 0 | 0 | 0 | 0 |
| DLEU1 | 0 | 0 | 0 | 0 | 0 | 0 |
| DLGAP5 | 0 | 0 | 0 | 0 | 0 | 0 |
| DNAJA1 | 0 | 0 | 0 | 0 | 0 | 0 |
| DNAJB9 | 0 | 0 | 0 | 0 | 0 | 0 |
| DNAJC10 | 0 | −12.209423 | 0 | 0 | 0 | 0 |
| DNMT3A | 0 | 0 | 0 | 0 | 0 | 0 |
| DOCK10 | 0 | 15.87228876 | 0 | 0 | 17.13938941 | 0 |
| DPY19L1 | 0 | 0 | 0 | 0 | 0 | 0 |
| DPYSL3 | 0 | 0 | 0 | 0 | −2.427210322 | 0 |
| DRAM | 0 | 0 | 0 | 0 | 0 | 0 |
| DTX1 | 0 | 0 | 0 | 0 | 0 | 0 |
| E2F2 | 0 | 0 | 0 | 4.871853059 | 0 | 0 |
| E2F8 | 0 | 0 | 0 | 0 | 0 | 0 |
| EBV_BZLF1 | 0 | 0 | 0 | 0 | 0 | 0 |
| EBV_EBER1 | 0 | 0 | 0 | 0 | 0 | 0 |
| EBV_EBER2 | 0 | 0 | 0 | 0 | 0 | 0 |
| EBV_EBNA1_CDS | 0 | 0 | 0 | 0 | 0 | 0 |
| EBV_EBNA2_3'_end | 0 | 0 | 0 | 0 | 0 | 0 |
| EBV_EBNA2_long | 0 | 0 | 0 | 0 | 0 | 0 |
| EBV_EBNA3A | 0 | 0 | 0 | 0 | 0 | 0 |
| EBV_EBNA3B | 0 | 0 | 0 | 0 | 0 | 0 |
| EBV_EBNA3C | 0 | 0 | 0 | 0 | 0 | 0 |
| EBV_LMP1_3'_end | 0 | 0 | 0 | 0 | 0 | 0 |
| EBV_LMP1_unique | 0 | 0 | 0 | 0 | 0 | 0 |
| EBV_LPM2A | 0 | 0 | 0 | 0 | 0 | 0 |
| EEPD1 | 0 | −14.43898719 | 0 | 0 | 0 | 0 |
| EFEMP2 | 0 | 0 | 0 | 0 | −2.309390981 | 0 |
| EGFL7 | 0 | 0 | 0 | 0 | 0 | 0 |
| EHD2 | 0 | 0 | 0 | 0 | 0 | 0 |
| EIF5AL1 | 0 | 0 | 0 | 0 | 0 | 0 |
| ELL2 | 0 | 12.74051826 | 0 | −5.784944094 | 0 | 0 |
| EML1 | 0 | 0 | 0 | 0 | −2.370584039 | 0 |
| EMR1 | 0 | 0 | 0 | 0 | 0 | 0 |
| ENO1 | 0 | 0 | 0 | 0 | 0 | 0 |
| ENPP3 | 0 | 0 | 0 | 0 | 0 | 0 |
| ENTPD1 | 0 | 12.50562718 | 0 | 0 | 0 | 0 |
| EP300 | 0 | 0 | 0 | 0 | 0 | 0 |
| EPHB1 | 0 | 0 | 0 | 0 | 0 | 0 |
| EPSTI1 | 0 | 0 | 0 | 0 | 0 | 0 |
| ERG | 0 | 0 | 0 | 0 | 0 | 0 |
| ERP29 | 0 | 14.40630514 | 0 | 0 | 0 | 0 |
| TXNDC4 | 0 | 0 | 0 | 0 | 0 | 0 |
| ESPL1 | 0 | 0 | 0 | 0 | 0 | 0 |
| ETV6 | 0 | 17.10124803 | 0 | 0 | 0 | 0 |
| EXO1 | 0 | 0 | 0 | 0 | 0 | 0 |
| FABP4 | 0 | 0 | 0 | 0 | 0 | 0 |
| FAM108C1 | 0 | 13.9119712 | 0 | 0 | 0 | 0 |
| FAM159A | 0 | 0 | 0 | 0 | −19.09112771 | 0 |
| FAM171B | 0 | 0 | 0 | 0 | 20.15840479 | 0 |
| FAM46C | 0 | 16.04589049 | 0 | 0 | 0 | 0 |
| FAM69A | 0 | 0 | 0 | 0 | 20.26920874 | 0 |
| FAM83D | 0 | 0 | 0 | 0 | 0 | 0 |
| FAP | 0 | 0 | 0 | 0 | −2.448537997 | 0 |
| FAS | 0 | 0 | 0 | 0 | 19.4917463 | 0 |
| FBP2 | 0 | 0 | 0 | 0 | 0 | 0 |
| FBXO10 | 0 | 0 | 0 | 0 | 0 | 0 |
| FBXO11 | 0 | 0 | 0 | 0 | 0 | 0 |
| FCER2 | 0 | 0 | 0 | 0 | 19.36530173 | 0 |
| FEZ1 | 0 | 0 | 0 | 0 | 0 | 0 |
| FGL2 | 0 | 0 | 0 | 0 | 0 | 0 |
| FKBP11 | 0 | 10.77110305 | 0 | 0 | 0 | 0 |
| FKBP2 | 0 | 0 | 0 | 0 | 0 | 0 |
| FLJ42418 | 0 | −13.07282539 | 0 | 0 | 0 | 0 |
| FLNA | 0 | 0 | 0 | 0 | 0 | 0 |
| FN1 | 0 | 0 | 0 | 0 | −2.515692387 | 0 |
| FNBP1 | 0 | 0 | 0 | 0 | 0 | 0 |
| FNDC1 | 0 | −9.924277783 | 0 | 0 | −2.337279029 | 0 |

TABLE 4-continued

| Gene | Normalization weights | ABC/GCB weights | BL non-Myc weights | BL myc weights | PMBL Weights | MCL Weights |
|---|---|---|---|---|---|---|
| FOXM1 | 0 | 0 | 0 | 0 | 0 | 0 |
| FOXO1 | 0 | 0 | 0 | 0 | 0 | 0 |
| FOXP1 | 0 | 0 | 0 | 0 | 0 | 0 |
| FSCN1 | 0 | 0 | 0 | 0 | 0 | 0 |
| FUT8 | 0 | 12.89311878 | 0 | 0 | 0 | 0 |
| FYB | 0 | 0 | 0 | 0 | 0 | 0 |
| GBP1 | 0 | 0 | 0 | 0 | 0 | 0 |
| GBP4 | 0 | 0 | 0 | 0 | 0 | 0 |
| GCET2 | 0 | 0 | 0 | 0 | 17.14715594 | 0 |
| GGT1 | 0 | 0 | 0 | 0 | 0 | 0 |
| GHR | 0 | 0 | 0 | 0 | 0 | 0 |
| GLDC | 0 | 0 | 0 | 0 | 0 | 0 |
| GLRX | 0 | 0 | 0 | 0 | 0 | 0 |
| GNA13 | 0 | −13.98237394 | 0 | 0 | 0 | 0 |
| GNB4 | 0 | 0 | 0 | 0 | 0 | 0 |
| GNG10 | 0 | 0 | 0 | 0 | 0 | 0 |
| GNL3 | 0 | 13.0455436 | 0.131002027 | −6.622162805 | 0 | 0 |
| GPR116 | 0 | 0 | 0 | 0 | 0 | 0 |
| GPR176 | 0 | 0 | 0 | 0 | 0 | 0 |
| GPR183 | 0 | 0 | 0 | 0 | 0 | 0 |
| GRAMD1B | 0 | 0 | 0 | 0 | 0 | 0 |
| GRB10 | 0 | 0 | 0 | 0 | 0 | 0 |
| GRSF1 | 0 | 0 | 0 | 0 | 0 | 0 |
| GTSE1 | 0 | 0 | 0 | 0 | 0 | 0 |
| GLT8D4 | 0 | 0 | 0 | 0 | 0 | 0 |
| GYPC | 0 | 0 | 0 | 0 | 17.83003931 | 0 |
| H2AFV | 0 | 0 | 0 | 0 | 0 | 0 |
| H2AFX | 0 | 0 | 0 | 0 | 0 | 0 |
| HCK | 0 | 15.54344514 | 0 | −5.412764958 | 0 | 0 |
| HDAC1 | 0 | −15.02975702 | 0 | 0 | 0 | 0 |
| HDAC2 | 0 | 0 | 0 | 0 | 0 | 0 |
| HDGF | 0 | 0 | 0.116000721 | −5.863845581 | 0 | 0 |
| HEG1 | 0 | 0 | 0 | 0 | −2.46106726 | 0 |
| HHV8_BCL2_homologue | 0 | 0 | 0 | 0 | 0 | 0 |
| HHV8_K1-32_Bcb_K1_protein | 0 | 0 | 0 | 0 | 0 | 0 |
| HHV8_ORF73-LANA | 0 | 0 | 0 | 0 | 0 | 0 |
| HHV8_T0.7/P6 | 0 | 0 | 0 | 0 | 0 | 0 |
| HHV8_T1.1 | 0 | 0 | 0 | 0 | 0 | 0 |
| HHV8_vFLIP_ORF71 | 0 | 0 | 0 | 0 | 0 | 0 |
| HHV8_vIL6 | 0 | 0 | 0 | 0 | 0 | 0 |
| HHV8_vMIP1b_ORFK4.2_KIE-3 | 0 | 0 | 0 | 0 | 0 | 0 |
| HJURP | 0 | 0 | 0 | 0 | 0 | 0 |
| HLA-A | 0 | 0 | 0 | 0 | 0 | 0 |
| HLA-B | 0 | 0 | 0 | 0 | 0 | 0 |
| HLA-C | 0 | 0 | 0 | 0 | 0 | 0 |
| HLA-DMA | 0 | 0 | 0 | −4.825417012 | 0 | 0 |
| HLA-DPA1 | 0 | 0 | 0 | 0 | 0 | 0 |
| HLA-DPB1 | 0 | 0 | 0 | 0 | 0 | 0 |
| HLA-DQA1 | 0 | 0 | 0 | 0 | 0 | 0 |
| HLA-DRA | 0 | 0 | 0 | 0 | 0 | 0 |
| HLA-E | 0 | 0 | 0 | 0 | 0 | 0 |
| HLA-F | 0 | 0 | 0 | 0 | 0 | 0 |
| HOMER2 | 0 | 0 | 0 | 0 | 19.38721241 | 0 |
| HOPX | 0 | −14.01730842 | 0 | 0 | 0 | 0 |
| HPCAL1 | 0 | 0 | 0 | 0 | 0 | 59.25326244 |
| HSP90B1 | 0 | 15.53130763 | 0 | 0 | 0 | 0 |
| HSPB8 | 0 | 0 | 0 | 0 | −2.192325405 | 0 |
| HTRA1 | 0 | 0 | 0 | 0 | −2.354416381 | 0 |
| HYOU1 | 0 | 0 | 0 | 0 | 0 | 0 |
| ICAM1 | 0 | 0 | 0 | −5.307124944 | 0 | 0 |
| ID1 | 0 | 0 | 0 | 0 | 0 | 0 |
| ID2 | 0 | 0 | 0 | 0 | 0 | 0 |
| ID3 | 0 | 0 | 0 | 0 | 0 | 0 |
| IDS | 0 | 0 | 0 | 0 | 0 | 0 |
| IER3 | 0 | 0 | 0 | 0 | 0 | 0 |
| IFI16 | 0 | 0 | 0 | 0 | 0 | 0 |
| IFI35 | 0 | 0 | 0 | 0 | 0 | 0 |
| IFI44L | 0 | 0 | 0 | 0 | 0 | 0 |
| IFI6 | 0 | 0 | 0 | 0 | 0 | 0 |
| IFIH1 | 0 | 0 | 0 | 0 | 21.31413442 | 0 |
| IFIT1 | 0 | 0 | 0 | 0 | 0 | 0 |
| IFIT2 | 0 | 0 | 0 | 0 | 0 | 0 |
| IFIT3 | 0 | 0 | 0 | 0 | 0 | 0 |
| IFITM1 | 0 | 0 | 0 | 0 | 0 | 0 |
| IFNAR1 | 0 | 0 | 0 | 0 | 0 | 0 |
| IFNAR2 | 0 | 0 | 0 | 0 | 0 | 0 |
| IFNB1 | 0 | 0 | 0 | 0 | 0 | 0 |

TABLE 4-continued

| Gene | Normalization weights | ABC/GCB weights | BL non-Myc weights | BL myc weights | PMBL Weights | MCL Weights |
|---|---|---|---|---|---|---|
| IgA2__constant__region | 0 | 0 | 0 | 0 | 0 | 0 |
| IgE__constant__region | 0 | 0 | 0 | 0 | 0 | 0 |
| IGFBP5 | 0 | 0 | 0 | 0 | 0 | 0 |
| IgG2__constant__region | 0 | 0 | 0 | 0 | 0 | 0 |
| IgG4__constant__region | 0 | 0 | 0 | 0 | 0 | 0 |
| IGSF3 | 0 | 11.04304441 | 0 | 0 | 18.36718646 | 0 |
| IL10 | 0 | 0 | 0 | 0 | 0 | 0 |
| IL12A | 0 | 10.87451224 | 0 | 0 | 0 | 0 |
| IL13 | 0 | 0 | 0 | 0 | 0 | 0 |
| IL13RA1 | 0 | 0 | 0 | −5.477834924 | 22.21511102 | 0 |
| IL16 | 0 | 15.38015948 | 0 | 0 | 0 | 0 |
| IL17RB | 0 | 10.16999574 | 0 | 0 | 0 | 0 |
| IL4I1 | 0 | 0 | 0 | 0 | 0 | 0 |
| IL6 | 0 | 0 | 0 | 0 | 0 | 0 |
| ING1 | 0 | 0 | 0 | 0 | 0 | 0 |
| INPP5D | 0 | 0 | 0 | 0 | 0 | 0 |
| IRAK1 | 0 | 0 | 0 | 0 | 0 | 0 |
| IRAK2 | 0 | 0 | 0 | 0 | 0 | 0 |
| IRAK3 | 0 | 0 | 0 | 0 | 0 | 0 |
| IRAK4 | 0 | 0 | 0 | 0 | 0 | 0 |
| IRF1 | 0 | 0 | 0 | 0 | 0 | 0 |
| IRF3 | 0 | 0 | 0 | 0 | 0 | 0 |
| IRF4 | 0 | 21.21696785 | 0 | 0 | 0 | 0 |
| IRF5 | 0 | 0 | 0 | 0 | 0 | 0 |
| IRF7 | 0 | 0 | 0 | 0 | 0 | 0 |
| ISG15 | 0 | 0 | 0 | 0 | 18.22975543 | 0 |
| ITGA9 | 0 | 0 | 0 | 0 | 0 | 0 |
| ITGAV | 0 | 0 | 0 | 0 | −2.502427838 | 0 |
| ITGAX | 0 | 0 | 0 | 0 | −2.527107115 | 0 |
| ITGB2 | 0 | 0 | 0 | −5.354319759 | 0 | 0 |
| ITPKB | 0 | −19.39129721 | 0 | 0 | 0 | 0 |
| JAK1 | 0 | 0 | 0 | 0 | 0 | 0 |
| JAK2 | 0 | 0 | 0 | 0 | 18.78741327 | 0 |
| JAK3 | 0 | 0 | 0 | −4.911758111 | 0 | 0 |
| KCNJ1 | 0 | 0 | 0 | 0 | 0 | 0 |
| KCNK12 | 0 | −12.19178395 | 0 | 0 | 0 | 0 |
| KCNMA1 | 0 | 0 | 0 | 0 | 0 | 0 |
| JMJD2C | 0 | 0 | 0 | 0 | 0 | 0 |
| KDR | 0 | 0 | 0 | 0 | 0 | 0 |
| KIAA1147 | 0 | 0 | 0 | 0 | 0 | 0 |
| KIAA1274 | 0 | −11.88673995 | 0 | 0 | 0 | 0 |
| KIF11 | 0 | 0 | 0 | 0 | 0 | 0 |
| KIF14 | 0 | 0 | 0 | 0 | 0 | 0 |
| KIF15 | 0 | 0 | 0 | 0 | 0 | 0 |
| KIF18A | 0 | 0 | 0 | 0 | 0 | 0 |
| KIF18B | 0 | 0 | 0 | 0 | 0 | 0 |
| KIF20A | 0 | 0 | 0 | 0 | 0 | 0 |
| KIF23 | 0 | 0 | 0 | 0 | 0 | 0 |
| KIF2C | 0 | 0 | 0 | 0 | 0 | 0 |
| KIF4A | 0 | 0 | 0 | 0 | 0 | 0 |
| KLHL5 | 0 | −10.77233553 | 0 | 0 | 0 | 0 |
| KPNA2 | 0 | 0 | 0 | 0 | 0 | 0 |
| KYNU | 0 | 0 | 0 | 0 | 23.67824397 | 0 |
| LAMB1 | 0 | 0 | 0 | 0 | 0 | 0 |
| LAMP3 | 0 | 0 | 0 | 0 | 0 | 0 |
| LANCL1 | 0 | −11.96529389 | 0 | 0 | 0 | 0 |
| LAT | 0 | 0 | 0 | 0 | 0 | 0 |
| LAT2 | 0 | 0 | 0 | 0 | 0 | 0 |
| LDHA | 0 | 0 | 0 | 0 | 0 | −62.43798035 |
| LHFPL3 | 0 | 0 | 0 | 0 | 0 | 0 |
| LHX2 | 0 | 0 | 0 | 0 | 0 | 0 |
| LIMA1 | 0 | 0 | 0 | 0 | 22.38509346 | 0 |
| LIMD1 | 0 | 17.83248768 | 0 | 0 | 0 | 0 |
| LMAN2 | 0 | 0 | 0 | 0 | 0 | 0 |
| LMO2 | 0 | −16.98695863 | 0 | −9.427107802 | 0 | 0 |
| LOC643529 | 0 | 0 | 0 | 0 | 0 | 0 |
| LOXL2 | 0 | 0 | 0 | 0 | 0 | 0 |
| LPCAT3 | 0 | 0 | 0 | 0 | 0 | 0 |
| LRMP | 0 | −15.8755653 | 0 | 0 | 0 | 0 |
| LRPPRC | 0 | 0 | 0 | 0 | 0 | 0 |
| LRRC15 | 0 | −12.69088474 | 0 | 0 | −2.555292482 | 0 |
| LRRC33 | 0 | 15.08028382 | 0 | 0 | 0 | 0 |
| LTBP2 | 0 | 0 | 0 | 0 | −2.274436223 | 0 |
| LYPD6B | 0 | −12.18942045 | 0 | 0 | 0 | 0 |
| LYZ | 0 | 0 | 0 | 0 | −2.548310761 | 0 |
| MACROD2 | 0 | 0 | 0 | 0 | 0 | 0 |
| MAL | 0 | 0 | 0 | 0 | 21.94306064 | 0 |

TABLE 4-continued

| Gene | Normalization weights | ABC/GCB weights | BL non-Myc weights | BL myc weights | PMBL Weights | MCL Weights |
|---|---|---|---|---|---|---|
| MALT1 | 0 | 0 | 0 | 0 | 0 | 0 |
| MAML3 | 0 | −17.94799886 | 0 | 0 | 0 | 0 |
| MAP3K1 | 0 | 0 | 0 | 0 | 0 | 55.17626389 |
| MAP3K8 | 0 | 0 | 0 | 0 | 0 | 0 |
| MAP4K4 | 0 | −10.29136026 | 0 | 0 | 0 | 0 |
| MAPK10 | 0 | −14.19048558 | 0 | 0 | 0 | 0 |
| MAPKAPK5 | 0 | 0 | 0 | 0 | 0 | 0 |
| MARCKS | 0 | 0 | 0 | 0 | 0 | 0 |
| MARCKSL1 | 0 | −16.15992041 | 0 | −5.183663919 | 0 | 0 |
| MAST2 | 0 | −13.37445723 | 0 | 0 | 0 | 0 |
| MATR3 | 0 | 0 | 0 | 0 | 0 | 0 |
| MCL1 | 0 | 0 | 0 | 0 | 0 | 0 |
| MCM10 | 0 | 0 | 0 | 0 | 0 | 0 |
| MCM7 | 0 | 0 | 0 | 0 | 0 | 0 |
| MDFIC | 0 | 0 | 0 | −6.830814658 | 0 | 0 |
| MDM2 | 0 | 0 | 0 | 0 | 0 | 0 |
| MFAP5 | 0 | 0 | 0 | 0 | 0 | 0 |
| MFNG | 0 | 0 | 0 | 0 | 0 | 0 |
| MFSD2A | 0 | 0 | 0 | 0 | 0 | 0 |
| MGC87042 | 0 | 0 | 0 | 0 | 0 | 0 |
| MIR17HG | 0 | 0 | 0 | 0 | 0 | 0 |
| MKI67 | 0 | 0 | 0 | 0 | 0 | 0 |
| MME | 0 | −18.26084621 | 0 | 0 | 0 | 0 |
| MMP1 | 0 | 0 | 0 | 0 | 0 | 0 |
| MMP2 | 0 | 0 | 0 | 0 | −2.575770684 | 0 |
| MMP9 | 0 | 0 | 0 | 0 | −2.62062289 | 0 |
| MMRN2 | 0 | 0 | 0 | 0 | 0 | 0 |
| MNDA | 0 | 0 | 0 | 0 | 0 | 0 |
| MOBKL2C | 0 | 0 | 0 | 0 | 24.05195347 | 0 |
| MPEG1 | 0 | 13.61757622 | 0 | 0 | 0 | 0 |
| MS4A1 | 0 | 0 | 0 | 0 | 0 | 0 |
| MST1R | 0 | 0 | 0 | 0 | 0 | 0 |
| MTHFD2 | 0 | 0 | 0 | 0 | 0 | −64.88192756 |
| MUC16 | 0 | 0 | 0 | 0 | 0 | 0 |
| MYB | 0 | 0 | 0 | 6.206314452 | 0 | 0 |
| MYBL1 | 0 | −19.42564163 | 0 | 0 | 0 | 0 |
| MYC | 0 | 0 | 0.129410593 | −6.541715697 | 0 | 0 |
| MYD88 | 0 | 0 | 0 | 0 | 0 | 0 |
| MYO7A | 0 | 0 | 0 | 0 | 0 | 0 |
| FAM128B | 0 | 0 | 0 | 0 | 0 | 0 |
| NANS | 0 | 0 | 0 | −5.411187191 | 0 | −62.00052085 |
| NASP | 0 | 0 | 0 | 0 | 0 | 0 |
| NBN | 0 | 0 | 0 | 0 | 0 | 0 |
| NCAPG | 0 | 0 | 0 | 0 | 0 | 0 |
| NCAPH | 0 | 0 | 0 | 0 | 0 | 0 |
| NCF2 | 0 | 0 | 0 | 0 | 17.12736383 | 0 |
| NCRNA00158 | 0 | 0 | 0 | 0 | 0 | 0 |
| NDST4 | 0 | 0 | 0 | 0 | 0 | 0 |
| NECAP2 | 0 | 0 | 0 | 0 | 17.90953211 | 0 |
| NEIL1 | 0 | −16.14074081 | 0 | 0 | 0 | 0 |
| NEK6 | 0 | −14.536944 | 0 | 0 | 0 | 0 |
| NFATC1 | 0 | 0 | 0 | 0 | 0 | 0 |
| NFIL3 | 0 | 0 | 0 | 0 | 23.55828096 | 0 |
| NFKBIA | 0 | 0 | 0 | 0 | 0 | 0 |
| NFKBIZ | 0 | 14.96909754 | 0 | 0 | 0 | 0 |
| NIPA2 | 0 | 12.59506241 | 0 | 0 | 0 | 0 |
| NOC3L | 0 | 11.52493513 | 0 | 0 | 0 | 0 |
| NOL14 | 0 | 0 | 0 | 0 | 0 | 0 |
| NOL5A | 0 | 0 | 0.123010002 | −6.218165306 | 0 | 0 |
| NOTCH1 | 0 | 0 | 0 | 0 | 0 | 0 |
| NOTCH2 | 0 | 0 | 0 | 0 | 0 | 0 |
| NUF2 | 0 | 0 | 0 | 0 | 0 | 0 |
| NUP62 | 0 | 0 | 0 | 0 | 0 | 0 |
| NUSAP1 | 0 | 0 | 0 | 0 | 0 | 0 |
| OAS2 | 0 | 0 | 0 | 0 | 0 | 0 |
| OAS3 | 0 | 0 | 0 | 0 | 0 | 0 |
| OPN3 | 0 | 0 | 0 | 0 | 0 | 0 |
| OSBPL3 | 0 | −13.37500509 | 0 | 0 | 0 | 0 |
| PA2G4 | 0 | 0 | 0 | 0 | 0 | 0 |
| PAG1 | 0 | −16.35818989 | 0 | 0 | 0 | 0 |
| DKFZP564O0823 | 0 | 0 | 0 | 0 | 0 | 0 |
| PAX6 | 0 | 0 | 0 | 0 | 0 | 0 |
| PCNA | 0 | 0 | 0 | 0 | 0 | 0 |
| PDCD1LG2 | 0 | 0 | 0 | 0 | 0 | 0 |
| PDE9A | 0 | −12.58569832 | 0 | 0 | 0 | 0 |
| PDGFRA | 0 | 0 | 0 | 0 | 0 | 0 |
| PDIA4 | 0 | 0 | 0 | 0 | 0 | 0 |

TABLE 4-continued

| Gene | Normalization weights | ABC/GCB weights | BL non-Myc weights | BL myc weights | PMBL Weights | MCL Weights |
|---|---|---|---|---|---|---|
| PDIA5 | 0 | 11.45635103 | 0 | 0 | 0 | 0 |
| PDK4 | 0 | 0 | 0 | 0 | 0 | 0 |
| PDLIM1 | 0 | 14.15712166 | 0 | 0 | 0 | 0 |
| PDLIM3 | 0 | 0 | 0 | 0 | 0 | 0 |
| PDPN | 0 | 0 | 0 | 0 | −2.469335735 | 0 |
| PECAM1 | 0 | 0 | 0 | 0 | 0 | 0 |
| PECR | 0 | 0 | 0 | 0 | 0 | 0 |
| PGAM1 | 0 | 0 | 0 | 0 | 0 | 0 |
| PHC3 | 0 | 0 | 0 | 0 | 0 | 0 |
| PHF16 | 0 | 15.59828263 | 0 | 0 | 0 | 0 |
| PIK3CA | 0 | 0 | 0 | 0 | 0 | 0 |
| PIK3CD | 0 | 0 | 0 | 0 | 0 | 0 |
| PIM1 | 0 | 13.17752239 | 0 | 0 | 0 | 0 |
| PIM2 | 0 | 19.17848124 | 0 | 0 | 0 | 0 |
| PLAU | 0 | 0 | 0 | −4.942137646 | −2.638406534 | 0 |
| PLEK | 0 | 0 | 0 | −5.140753466 | 0 | 0 |
| PLEKHF2 | 0 | −14.32290025 | 0 | 0 | 0 | 0 |
| PLEKHG4B | 0 | 0 | 0 | 0 | 0 | 0 |
| PLXNB1 | 0 | 0 | 0 | 0 | 0 | 0 |
| PMEPA1 | 0 | −11.10781933 | 0 | 0 | −2.5144432 | 0 |
| PMP22 | 0 | 0 | 0 | 0 | 0 | 0 |
| NP | 0 | 11.18914667 | 0 | 0 | 0 | 0 |
| POU2AF1 | 0 | 0 | 0 | 0 | 0 | 0 |
| POU2F1 | 0 | 0 | 0 | 0 | 0 | 0 |
| POU2F2 | 0 | 0 | 0 | 0 | 0 | 0 |
| PPA1 | 0 | 0 | 0 | 0 | 0 | −58.07910524 |
| PPP2R3B | 0 | 0 | 0 | 0 | 0 | 0 |
| FAM152B | 0 | 0 | 0 | 0 | 0 | 0 |
| PRDM1 | 0 | 0 | 0 | 0 | 0 | 0 |
| PRDM12 | 0 | 0 | 0 | 0 | 0 | 0 |
| PRDX2 | 0 | 0 | 0 | 0 | −23.58686384 | 0 |
| PRDX4 | 0 | 0 | 0 | 0 | 0 | 0 |
| PRICKLE1 | 0 | 0 | 0 | 0 | 0 | 56.2707098 |
| PRKCB | 0 | 0 | 0 | 0 | −16.97009784 | 0 |
| PRMT1 | 0 | 0 | 0 | 0 | 0 | 0 |
| PRPSAP2 | 0 | −12.13413417 | 0 | 0 | 0 | 0 |
| PRSS1 | 0 | 0 | 0 | 0 | 0 | 0 |
| PSMG1 | 0 | 0 | 0 | 0 | 0 | 0 |
| PTEN | 0 | 0 | 0 | 0 | 0 | 0 |
| PTGER4 | 0 | 0 | 0 | 0 | 0 | 0 |
| PTGIR | 0 | 0 | 0 | 0 | 26.72740141 | 0 |
| PTK2 | 0 | −13.78968685 | 0 | −4.948036735 | 0 | 0 |
| PTPN1 | 0 | 13.38225581 | 0 | 0 | 0 | 0 |
| PTPRB | 0 | 0 | 0 | 0 | 0 | 0 |
| PVRL1 | 0 | 0 | 0 | 0 | 0 | 0 |
| PXDN | 0 | 0 | 0 | 0 | 0 | 0 |
| QSOX1 | 0 | 0 | 0 | 0 | 0 | 0 |
| RAB31 | 0 | 0 | 0 | 0 | 0 | 0 |
| RAB33A | 0 | 0 | 0 | −4.912839787 | 0 | 0 |
| RAB3A | 0 | 0 | 0 | 0 | 0 | 0 |
| RAB7L1 | 0 | 20.66492996 | 0 | 0 | 0 | 0 |
| RAPGEF5 | 0 | −14.68045686 | 0 | 0 | 0 | 0 |
| RARRES2 | 0 | 0 | 0 | 0 | −2.570678175 | 0 |
| RASGRP3 | 0 | 0 | 0 | −6.000117265 | 0 | 0 |
| RASSF4 | 0 | 0 | 0 | 0 | 0 | 0 |
| RBCK1 | 0 | 0 | 0 | 0 | 0 | 0 |
| RCL1 | 0 | 0 | 0 | 0 | 19.91410729 | 0 |
| REL | 0 | −10.88675527 | 0 | 0 | 0 | 0 |
| RFTN1 | 0 | −10.08136072 | 0 | 0 | 0 | 0 |
| RGL1 | 0 | 0 | 0 | 0 | 0 | 0 |
| RGS9 | 0 | 0 | 0 | 0 | 18.38318043 | 0 |
| RHEBL1 | 0 | 0 | 0 | 0 | 0 | 0 |
| RHOF | 0 | 0 | 0 | 0 | 19.45176982 | 0 |
| RHOXF1 | 0 | 0 | 0 | 0 | 0 | 0 |
| RNASEH2B | 0 | 0 | 0 | 0 | 0 | 0 |
| RNF31 | 0 | 0 | 0 | 0 | 0 | 0 |
| RNGTT | 0 | 0 | 0 | 0 | 0 | 0 |
| ROBO1 | 0 | 0 | 0 | 0 | −2.163573921 | 0 |
| ROBO4 | 0 | 0 | 0 | 0 | 0 | 0 |
| RPN2 | 0 | 0 | 0 | 0 | 0 | 0 |
| RPS6KA5 | 0 | 0 | 0 | 0 | 0 | 0 |
| RSAD2 | 0 | 0 | 0 | 0 | 0 | 0 |
| RTCD1 | 0 | 0 | 0 | 0 | 0 | 0 |
| RUNDC2B | 0 | 0 | 0 | 0 | 0 | 0 |
| RXRA | 0 | 0 | 0 | 0 | 0 | 0 |
| S100Z | 0 | −12.22316337 | 0 | 0 | 0 | 0 |
| S1PR2 | 0 | −21.44566507 | 0 | 0 | 0 | 0 |

TABLE 4-continued

| Gene | Normalization weights | ABC/GCB weights | BL non-Myc weights | BL myc weights | PMBL Weights | MCL Weights |
|---|---|---|---|---|---|---|
| SAA1 | 0 | 0 | 0 | 0 | 0 | 0 |
| SACS | 0 | 12.97435391 | 0 | 0 | 0 | 0 |
| SAE1 | 0 | 0 | 0 | 0 | 0 | 0 |
| SAMSN1 | 0 | 0 | 0 | −5.803971429 | 22.68315196 | 0 |
| SAP30 | 0 | 0 | 0 | 0 | 0 | 0 |
| SCARA5 | 0 | 0 | 0 | 0 | −2.335496267 | 0 |
| SDC1 | 0 | 0 | 0 | 0 | 0 | 0 |
| SDCCAG8 | 0 | 0 | 0 | 0 | 0 | 0 |
| KIAA0746 | 0 | −15.04224714 | 0 | 0 | 0 | 0 |
| SEMA7A | 0 | 0 | 0 | 0 | 0 | 0 |
| SEPHS1 | 0 | 0 | 0 | 0 | 0 | 0 |
| SERBP1 | 0 | 0 | 0 | 0 | 0 | 0 |
| SERPINA9 | 0 | −17.70615386 | 0 | −4.937282176 | 0 | 0 |
| SERPINB1 | 0 | 0 | 0 | 0 | 0 | 0 |
| SFN | 0 | 0 | 0 | 0 | 0 | 0 |
| SFPQ | 0 | 0 | 0 | 0 | 0 | 0 |
| SGK1 | 0 | −9.835329752 | 0 | −5.684745402 | 0 | 0 |
| SGOL2 | 0 | 0 | 0 | 0 | 0 | 0 |
| SH2D1A | 0 | 0 | 0 | 0 | 0 | 0 |
| SH3BP5 | 0 | 17.2475192 | 0 | 0 | 0 | 0 |
| SHARPIN | 0 | 0 | 0 | 0 | 0 | 0 |
| SIDT1 | 0 | 10.70030882 | 0 | 0 | 0 | 0 |
| SIRPA | 0 | 0 | 0 | 0 | 0 | 0 |
| SIRPB1 | 0 | 0 | 0 | 0 | 0 | 0 |
| SLA | 0 | 16.00267223 | 0 | 0 | 0 | 0 |
| SLAMF1 | 0 | −13.70193031 | 0 | −5.135970135 | 20.7055292 | 0 |
| SLC12A8 | 0 | 0 | 0 | 0 | 0 | 0 |
| SLC16A9 | 0 | 0 | 0 | 0 | 0 | 0 |
| SLC1A4 | 0 | 0 | 0 | 0 | 0 | 0 |
| SLC31A1 | 0 | 0 | 0 | 0 | 0 | 0 |
| SLC35E2B | 0 | 0 | 0 | 0 | 0 | 0 |
| SLC38A5 | 0 | 16.76798547 | 0 | 0 | 0 | 0 |
| SMAD1 | 0 | 0 | 0 | 0 | 0 | 0 |
| SMAD7 | 0 | 0 | 0 | 0 | 0 | 0 |
| SMARCA4 | 0 | −13.90289239 | 0 | 5.037186022 | 0 | 0 |
| SNAP23 | 0 | 0 | 0 | 0 | 0 | 0 |
| SNN | 0 | 0 | 0 | 0 | 0 | 67.01976847 |
| SNX11 | 0 | 0 | 0 | 0 | 22.05768278 | 0 |
| SNX22 | 0 | −13.10658722 | 0 | 0 | 0 | 0 |
| SNX29 | 0 | 0 | 0 | 0 | 19.13395502 | 0 |
| SOCS1 | 0 | 0 | 0 | 0 | 0 | 0 |
| SOCS2 | 0 | 0 | 0 | 0 | 0 | 0 |
| SOCS3 | 0 | 0 | 0 | 0 | 0 | 0 |
| SORBS1 | 0 | 0 | 0 | 0 | 0 | 0 |
| SOX11 | 0 | 0 | 0 | 0 | 0 | 54.39896926 |
| SOX5 | 0 | 0 | 0 | 0 | 0 | 0 |
| SPAG5 | 0 | 0 | 0 | 0 | 0 | 0 |
| SPARC | 0 | 0 | 0 | 0 | −2.470075697 | 0 |
| SPARCL1 | 0 | 0 | 0 | 0 | 0 | 0 |
| SPIB | 0 | 0 | 0 | 0 | 0 | 0 |
| SPINK2 | 0 | −10.030466 | 0 | 0 | 0 | 0 |
| SPINT2 | 0 | 0 | 0 | 0 | 19.59153543 | 0 |
| SPON1 | 0 | 0 | 0 | 0 | 0 | 0 |
| SPRED2 | 0 | −11.78392433 | 0 | 0 | 0 | 0 |
| SPRY1 | 0 | 0 | 0 | 0 | 0 | 0 |
| SRPK1 | 0 | 0 | 0 | 0 | 0 | 0 |
| SRPX | 0 | 0 | 0 | 0 | 0 | 0 |
| SRSF1 | 0 | 0 | 0 | 0 | 0 | 0 |
| SSBP2 | 0 | −16.54355885 | 0 | 0 | 0 | 0 |
| STAG3 | 0 | 0 | 0 | 0 | 0 | 0 |
| STAMBPL1 | 0 | 14.49186031 | 0 | 0 | 0 | 0 |
| STAP1 | 0 | −12.71264348 | 0 | 0 | 0 | 0 |
| STAT1 | 0 | 0 | 0 | 0 | 0 | 0 |
| STAT3 | 0 | 10.99589419 | 0 | −5.30437752 | 0 | 0 |
| STEAP1 | 0 | 0 | 0 | 0 | 0 | 0 |
| STK17A | 0 | −12.60874641 | 0 | 0 | 0 | 0 |
| STK38L | 0 | 0 | 0 | 0 | 0 | 0 |
| STMN1 | 0 | 0 | 0 | 0 | 0 | 0 |
| STS | 0 | −9.978596163 | 0 | 0 | 0 | 0 |
| STX11 | 0 | 0 | 0 | −5.423455974 | 0 | 0 |
| SULF1 | 0 | 0 | 0 | 0 | −2.512044172 | 0 |
| SYK | 0 | 0 | 0 | 0 | 0 | 0 |
| SYPL1 | 0 | 0 | 0 | 0 | 0 | 0 |
| SYT17 | 0 | 0 | 0 | 0 | 0 | 0 |
| SYTL4 | 0 | 0 | 0 | 0 | 0 | 0 |
| TARS | 0 | 13.55653507 | 0 | 0 | 0 | 0 |
| TAX1BP1 | 0 | 0 | 0 | 0 | 0 | 0 |

TABLE 4-continued

| Gene | Normalization weights | ABC/GCB weights | BL non-Myc weights | BL myc weights | PMBL Weights | MCL Weights |
|---|---|---|---|---|---|---|
| TBC1D27 | 0 | 0 | 0 | 0 | 0 | 0 |
| TBC1D9 | 0 | 0 | 0 | 0 | 0 | 61.55561013 |
| TCF3 | 0 | 0 | 0 | 5.046896623 | 0 | 0 |
| TCF4 | 0 | 15.61877166 | 0 | 0 | 0 | 0 |
| TCTN3 | 0 | 13.00379932 | 0 | 0 | 0 | 0 |
| TEAD1 | 0 | 0 | 0 | 0 | 0 | 0 |
| TEK | 0 | 0 | 0 | 0 | 0 | 0 |
| TERT | 0 | 0 | 0.125565268 | −6.347334222 | 0 | 0 |
| TEX9 | 0 | −12.41661821 | 0 | 0 | 0 | 0 |
| TFDP2 | 0 | 0 | 0 | 0 | 0 | 0 |
| TFPI2 | 0 | 0 | 0 | 0 | 0 | 0 |
| TGFBR1 | 0 | 0 | 0 | 0 | 0 | 0 |
| THBS2 | 0 | 0 | 0 | 0 | −2.458163143 | 0 |
| THY1 | 0 | 0 | 0 | 0 | −2.435821946 | 0 |
| TIAM2 | 0 | −10.50158544 | 0 | 0 | 0 | 0 |
| TICAM2 | 0 | 10.36653445 | 0 | −4.996251154 | 0 | 0 |
| TJP2 | 0 | 0 | 0 | 0 | 0 | 0 |
| TK1 | 0 | 0 | 0 | 0 | 0 | 0 |
| TLE4 | 0 | 0 | 0 | 0 | 17.47264051 | 0 |
| TLK1 | 0 | 12.28505922 | 0 | 0 | 0 | 0 |
| TLR7 | 0 | 0 | 0 | 0 | 19.4679966 | 0 |
| TM4SF1 | 0 | 0 | 0 | 0 | 0 | 0 |
| TMBIM6 | 0 | 0 | 0 | 0 | 0 | 0 |
| TMEM109 | 0 | 0 | 0 | 0 | 0 | 0 |
| TMEM119 | 0 | −10.5658305 | 0 | −5.379086543 | −2.658347176 | 0 |
| TMOD1 | 0 | 0 | 0 | 0 | 19.102924 | 0 |
| TMPRSS6 | 0 | 0 | 0 | 0 | 0 | 0 |
| TNF | 0 | 0 | 0 | 0 | 0 | 0 |
| TNFAIP2 | 0 | 0 | 0 | 0 | 0 | 0 |
| TNFAIP3 | 0 | 0 | 0 | 0 | 0 | 0 |
| TNFRSF13B | 0 | 19.52210849 | 0 | 0 | 0 | 0 |
| TNFRSF14 | 0 | 0 | 0 | 0 | 0 | 0 |
| TNFRSF17 | 0 | 0 | 0 | 0 | 20.07405253 | 0 |
| TNFRSF19 | 0 | 0 | 0 | 0 | 0 | 0 |
| TNFSF10 | 0 | 0 | 0 | 0 | 0 | 0 |
| TNFSF4 | 0 | 0 | 0 | 0 | 27.41538607 | 0 |
| TNIP2 | 0 | 0 | 0 | 0 | 0 | 0 |
| TNXB | 0 | 0 | 0 | 0 | 0 | 0 |
| TOP2A | 0 | 0 | 0 | 0 | 0 | 0 |
| TOX | 0 | −11.9192864 | 0 | 0 | 0 | 0 |
| TP53 | 0 | 0 | 0 | 0 | 0 | 0 |
| TP73 | 0 | 0 | 0 | 0 | 0 | 0 |
| TPM1 | 0 | 0 | 0 | 0 | −2.197810042 | 0 |
| TPX2 | 0 | 0 | 0 | 0 | 0 | 0 |
| TRAF1 | 0 | 0 | 0 | 0 | 21.57006782 | 0 |
| TRAF3 | 0 | 0 | 0 | 0 | 0 | 0 |
| TRIM25 | 0 | 0 | 0 | 0 | 0 | 0 |
| TRIM6-TRIM34 | 0 | 0 | 0 | 0 | 0 | 0 |
| TRIP13 | 0 | 0 | 0.122871716 | −6.211174921 | 0 | 0 |
| TTC9 | 0 | −12.56263701 | 0 | 0 | 0 | 0 |
| TUBG1 | 0 | 0 | 0 | 0 | 0 | 0 |
| TXN | 0 | 0 | 0 | 0 | 0 | 0 |
| TXNDC5 | 0 | 0 | 0 | 0 | 0 | 0 |
| TYK2 | 0 | 0 | 0 | 0 | 0 | 0 |
| TYMS | 0 | 0 | 0 | 0 | 0 | 0 |
| UBE2I | 0 | 0 | 0 | 0 | 0 | 0 |
| UBE2S | 0 | 0 | 0 | 0 | 0 | 0 |
| USP12 | 0 | −11.66057366 | 0 | 0 | 0 | 0 |
| USP18 | 0 | 0 | 0 | 0 | 0 | 0 |
| USP46 | 0 | 13.42760916 | 0 | 0 | 0 | 0 |
| VASH2 | 0 | 0 | 0 | 0 | 20.35631229 | 0 |
| VGLL4 | 0 | −12.24069542 | 0 | 0 | 0 | 0 |
| TMEM49 | 0 | 0 | 0 | 0 | 0 | 0 |
| VWF | 0 | 0 | 0 | 0 | 0 | 0 |
| WASF1 | 0 | 0 | 0 | 0 | 0 | 0 |
| WDR25 | 0 | 0 | 0 | 0 | 0 | 0 |
| WHSC1 | 0 | 0 | 0 | 0 | 0 | 0 |
| WNT3 | 0 | 0 | 0 | 0 | 0 | 55.5970345 |
| XAF1 | 0 | 0 | 0 | 0 | 0 | 0 |
| XBP1 | 0 | 10.72031521 | 0 | 0 | 0 | 0 |
| YPEL1 | 0 | 0 | 0 | 0 | 0 | 0 |
| ZAP70 | 0 | 0 | 0 | 0 | 0 | 0 |
| ZBTB32 | 0 | 12.89819312 | 0 | 0 | 0 | 0 |
| ZBTB38 | 0 | 0 | 0 | 0 | 0 | 0 |
| ZBTB8 | 0 | 0 | 0 | 0 | 22.31265521 | 0 |
| ZCCHC7 | 0 | −10.53054134 | 0 | 0 | 0 | 0 |
| ZFP36L1 | 0 | 0 | 0 | 0 | 0 | 0 |

TABLE 4-continued

| Gene | Normalization weights | ABC/GCB weights | BL non-Myc weights | BL myc weights | PMBL Weights | MCL Weights |
|---|---|---|---|---|---|---|
| ZMYND8 | 0 | 0 | 0 | 0 | 0 | 0 |
| ZNF238 | 0 | 0 | 0 | 0 | 0 | 0 |
| ZNF281 | 0 | 0 | 0 | 0 | 17.18038245 | 0 |
| ZNF318 | 0 | −14.69750421 | 0 | 0 | 0 | 0 |
| ZNF385B | 0 | 0 | 0 | 0 | 0 | 0 |
| ZNF608 | 0 | −12.02764268 | 0 | 0 | 0 | 0 |
| ZNRF1 | 0 | 0 | 0 | 0 | 0 | 0 |
| ZPBP2 | 0 | 0 | 0 | 0 | 0 | 0 |
| ZWINT | 0 | 0 | 0 | 0 | 0 | 0 |
| A2LD1 | 0 | 0 | 0 | 0 | 0 | 0 |
| ABCA12 | 0 | 0 | 0 | 0 | 0 | 0 |
| ACSL5 | 0.021276596 | 0 | 0 | 0 | 0 | 0 |
| AHCYL2 | 0.021276596 | 0 | 0 | 0 | 0 | 0 |
| AKAP9 | 0.021276596 | 0 | 0 | 0 | 0 | 0 |
| ASCL2 | 0 | 0 | 0 | 0 | 0 | 0 |
| ASMTL-AS1 | 0 | 0 | 0 | 0 | 0 | 0 |
| ATOH8 | 0 | 0 | 0 | 0 | 0 | 0 |
| ATXN7L2 | 0.021276596 | 0 | 0 | 0 | 0 | 0 |
| C19orf26 | 0 | 0 | 0 | 0 | 0 | 0 |
| C4orf31 | 0 | 0 | 0 | 0 | 0 | 0 |
| CA7 | 0 | 0 | 0 | 0 | 0 | 0 |
| CAMKK1 | 0 | 0 | 0 | 0 | 0 | 0 |
| CDK5RAP2 | 0.021276596 | 0 | 0 | 0 | 0 | 0 |
| CHD4 | 0.021276596 | 0 | 0 | 0 | 0 | 0 |
| CHST5 | 0 | 0 | 0 | 0 | 0 | 0 |
| CPA6 | 0 | −10.24419002 | 0 | 0 | 0 | 0 |
| DAZAP2 | 0.021276596 | 0 | 0 | 0 | 0 | 0 |
| DCLK3 | 0 | 0 | 0 | 0 | 0 | 0 |
| DNAJB12 | 0.021276596 | 0 | 0 | 0 | 0 | 0 |
| ERBB2IP | 0.021276596 | 0 | 0 | 0 | 0 | 0 |
| ERN2 | 0 | 0 | 0 | 0 | 0 | 0 |
| KIAA0574 | 0 | 0 | 0 | 0 | 0 | 0 |
| FAR2 | 0 | 0 | 0 | 0 | 0 | 0 |
| FARP1 | 0 | 0 | 0 | 0 | 0 | 0 |
| FBXL13 | 0 | 0 | 0 | 0 | 0 | 0 |
| FBXO36 | 0 | 0 | 0 | 0 | 0 | 0 |
| FBXO41 | 0.021276596 | 0 | 0 | 0 | 0 | 0 |
| FCN2 | 0 | 0 | 0 | 0 | 0 | 0 |
| GAD2 | 0 | 0 | 0 | 0 | 0 | 0 |
| GATA1 | 0 | 0 | 0 | 0 | 0 | 0 |
| GATA2 | 0 | 0 | 0 | 0 | 0 | 0 |
| GIT2 | 0.021276596 | 0 | 0 | 0 | 0 | 0 |
| GNG4 | 0 | 0 | 0 | 0 | 0 | 0 |
| GORASP1 | 0.021276596 | 0 | 0 | 0 | 0 | 0 |
| GSK3B | 0.021276596 | 0 | 0 | 0 | 0 | 0 |
| GYG2 | 0 | 0 | 0 | 0 | 0 | 0 |
| H1FOO | 0 | 0 | 0 | 0 | 0 | 0 |
| HARBI1 | 0.021276596 | 0 | 0 | 0 | 0 | 0 |
| HHIP | 0 | 0 | 0 | 0 | 0 | 0 |
| HSP90AA1 | 0.021276596 | 0 | 0 | 0 | 0 | 0 |
| HSPA12B | 0 | 0 | 0 | 0 | 0 | 0 |
| HSPA9 | 0.021276596 | 0 | 0 | 0 | 0 | 0 |
| IK | 0.021276596 | 0 | 0 | 0 | 0 | 0 |
| ISY1 | 0.021276596 | 0 | 0 | 0 | 0 | 0 |
| KCNQ3 | 0 | 0 | 0 | 0 | 0 | 0 |
| KCP | 0 | 0 | 0 | 0 | 0 | 0 |
| KIF6 | 0 | 0 | 0 | 0 | 0 | 0 |
| KRAS | 0.021276596 | 0 | 0 | 0 | 0 | 0 |
| LRP3 | 0 | 0 | 0 | 0 | 0 | 0 |
| MLL2 | 0.021276596 | 0 | 0 | 0 | 0 | 0 |
| MLLT10 | 0.021276596 | 0 | 0 | 0 | 0 | 0 |
| MSX2 | 0 | 0 | 0 | 0 | 0 | 0 |
| KIAA0774 | 0 | 0 | 0 | 0 | 0 | 0 |
| NAIF1 | 0.021276596 | 0 | 0 | 0 | 0 | 0 |
| NEBL | 0 | 0 | 0 | 0 | 0 | 0 |
| NEU3 | 0.021276596 | 0 | 0 | 0 | 0 | 0 |
| NHLH2 | 0 | 0 | 0 | 0 | 0 | 0 |
| NRG1 | 0 | 0 | 0 | 0 | 0 | 0 |
| OPA1 | 0.021276596 | 0 | 0 | 0 | 0 | 0 |
| PDE4DIP | 0 | 0 | 0 | 0 | 0 | 0 |
| RNUXA | 0.021276596 | 0 | 0 | 0 | 0 | 0 |
| PHF23 | 0.021276596 | 0 | 0 | 0 | 0 | 0 |
| PMCHL1 | 0 | 0 | 0 | 0 | 0 | 0 |
| PNLIP | 0 | 0 | 0 | 0 | 0 | 0 |
| PPP3CC | 0.021276596 | 0 | 0 | 0 | 0 | 0 |
| PTENP1 | 0 | 0 | 0 | 0 | 0 | 0 |
| PTPN21 | 0 | 0 | 0 | 0 | 0 | 0 |

TABLE 4-continued

| Gene | Normalization weights | ABC/GCB weights | BL non-Myc weights | BL myc weights | PMBL Weights | MCL Weights |
|---|---|---|---|---|---|---|
| PTRH1 | 0.021276596 | 0 | 0 | 0 | 0 | 0 |
| R3HDM1 | 0.021276596 | 0 | 0 | 0 | 0 | 0 |
| RAB20 | 0.021276596 | 0 | 0 | 0 | 0 | 0 |
| RANBP9 | 0.021276596 | 0 | 0 | 0 | 0 | 0 |
| RC3H2 | 0.021276596 | 0 | 0 | 0 | 0 | 0 |
| RETNLB | 0 | 0 | 0 | 0 | 0 | 0 |
| RHCE | 0 | 0 | 0 | 0 | 0 | 0 |
| RNF214 | 0.021276596 | 0 | 0 | 0 | 0 | 0 |
| RRP1B | 0.021276596 | 0 | 0 | 0 | 0 | 0 |
| SPATA6 | 0 | 0 | 0 | 0 | 0 | 0 |
| SPATS1 | 0 | 0 | 0 | 0 | 0 | 0 |
| SSPN | 0 | 0 | 0 | 0 | 0 | 0 |
| SUFU | 0.021276596 | 0 | 0 | 0 | 0 | 0 |
| SPAG4L | 0 | 0 | 0 | 0 | 0 | 0 |
| SYCP1 | 0 | 0 | 0 | 0 | 0 | 0 |
| THOC5 | 0.021276596 | 0 | 0 | 0 | 0 | 0 |
| TRIM56 | 0.021276596 | 0 | 0 | 0 | 0 | 0 |
| TRIM62 | 0.021276596 | 0 | 0 | 0 | 0 | 0 |
| TUBB2C | 0.021276596 | 0 | 0 | 0 | 0 | 0 |
| UBXN4 | 0.021276596 | 0 | 0 | 0 | 0 | 0 |
| VAC14 | 0.021276596 | 0 | 0 | 0 | 0 | 0 |
| VRK3 | 0.021276596 | 0 | 0 | 0 | 0 | 0 |
| WAC | 0.021276596 | 0 | 0 | 0 | 0 | 0 |
| WDR55 | 0.021276596 | 0 | 0 | 0 | 0 | 0 |
| WFDC9 | 0 | 0 | 0 | 0 | 0 | 0 |
| ZBTB37 | 0.021276596 | 0 | 0 | 0 | 0 | 0 |
| ZCCHC2 | 0.021276596 | 0 | 0 | 0 | 0 | 0 |
| ZFP42 | 0 | 0 | 0 | 0 | 0 | 0 |
| ZNF135 | 0 | 0 | 0 | 0 | 0 | 0 |
| ZNF598 | 0.021276596 | 0 | 0 | 0 | 0 | 0 |

TABLE 5

| Submodel | Lower Cut-point | Upper Cut-point |
|---|---|---|
| ABC/GCB | 712.91 | 1238.61 |
| BL Non-Myc | −89.39 | −60.39 |
| BL Myc | 1.11 | 1.11 |
| PMBL | −400.06 | −150.06 |
| MCL | −51.92 | 359.08 |

The five submodels can then be combined according to the logic set forth below and summarized in the FIGURE.
(1) If the MCL submodel has a value of 1, the sample is called MCL.
   If the MCL submodel has a value of 0, the sample is called unclassifiable but borderline MCL.
   If the MCL submodel has a value of −1, proceed to step 2.
(2) If the BL non-myc submodel has a value of 1, proceed to step 3.
   If the BL non-myc submodel has a value of 0, the sample is called unclassifiable but borderline BL.
   If the BL non-myc submodel has a value of −1, proceed to step 4.
(3) If the BL myc submodel has a value of 0 or 1, the sample is called BL.
   If the BL myc submodel has a value of −1, the sample is called unclassifiable but borderline BL.
(4) If the PMBL submodel has a value of 1, the sample is called PMBL.
   If the PMBL submodel has a value of 0, the sample is called unclassifiable but borderline PMBL.
   If the PMBL submodel has a value of −1, proceed to step 5.
(5) If the ABC/GCB submodel has a value of 1, the sample is called ABC.
   If the ABC/GCB submodel has a value of 0, the sample is called unclassified DLBCL.
   If the ABC/GCB submodel has a value of −1, the sample is called GCB.

A similar analysis can be performed to predict whether a subject already diagnosed with DLBCL has the germinal center B cell (GCB) subtype or the activated B cell (ABC) subtype using the 800 gene array. In this respect, the sample is assumed to be of non-PMBL DLBCL, so only a ABC/GCB submodel is used employing the following logic:
   If the ABC/GCB submodel has a value of 1, the sample is called ABC
   If the ABC/GCB submodel has a value of 0, the sample is called unclassified DLBCL
   If the ABC/GCB submodel has a value of −1, the sample is called GCB.

In another embodiment, evaluating the likelihood that a particular DLBCL sample belongs to either the ABC subtype or the GCB subtype can involve calculating a predictor score using the 20 gene array containing the genes set forth in Table 3. The predictor score can be calculated using the algorithms described above with respect to the classification of ABC DLBCL, GCB DLBCL, PMBL, BL, or MCL, but using a different set of model weights, housekeeping weights, and cut points. For example, the weights ($w_1$) associated with the 20 gene probe set for the particular submodel are set forth in Table 6. In this example, the lower cutpoint for the ABC/GCB submodel is 1988.2, while the upper cutpoint for the ABC/GCB submodel is 2513.9.

TABLE 6

| Gene | Normalization weights | ABC/GCB weights |
|---|---|---|
| ASB13 | 0 | −66.35 |
| CCDC50 | 0 | 40.54 |
| CREB3L2 | 0 | 65.79 |
| CYB5R2 | 0 | 67.72 |
| IRF4 | 0 | 71.92 |

TABLE 6-continued

| Gene | Normalization weights | ABC/GCB weights |
| --- | --- | --- |
| ISY1 | 0.2 | 0.00 |
| ITPKB | 0 | −67.78 |
| LIMD1 | 0 | 61.92 |
| MAML3 | 0 | −58.59 |
| MME | 0 | −56.55 |
| MYBL1 | 0 | −72.92 |
| PIM2 | 0 | 71.80 |
| R3HDM1 | 0.2 | 0.00 |
| RAB7L1 | 0 | 70.45 |
| S1PR2 | 0 | −78.74 |
| SERPINA9 | 0 | −61.81 |
| TNFRSF13B | 0 | 66.49 |
| TRIM56 | 0.2 | 0.00 |
| UBXN4 | 0.2 | 0 |
| WDR55 | 0.2 | 0 |

An alternative method to report the likelihood that a particular sample belongs to ABC DLBCL, GCB DLBCL, PMBL, BL, or MCL avoids assigning discrete prediction class labels to each sample and instead provides a vector of five confidence values. Each confidence value indicates the likelihood that the sample is of one of the five lymphoma types. For example, linear predictor scores are first created for each submodel $$z = \sum_i y_i w_i$$

as described above. However, rather than using discrete cut-points to indicate one of three discrete groups, the following transformation can be used to define a Bayesian sub-model score:

$$B_{Submodel} = \frac{\phi\left(\sum_i y_i w_i; m_1, v_1\right)}{\phi\left(\sum_i y_i w_i; m_1, v_1\right) + \phi\left(\sum_i y_i w_i; m_1, v_1\right)}$$

wherein $y_i$ is the value assigned probe set i as described above; $w_i$ are the weights associated with that probe set for the particular model as presented in Table 4; $m_1$, $v_1$, $m_2$, and $v_2$ are values associated with the submodel as set forth in Table 7, and $\Phi$ is the Gaussian density defined as follows:

$$\phi(y; m, v) = \frac{1}{\sqrt{2\pi v}} e^{\frac{-(y-m)^2}{v^2}}.$$

TABLE 7

| Submodel | $m_1$ | $m_2$ | $v_1$ | $v_2$ |
| --- | --- | --- | --- | --- |
| ABC/GCB | 2021.11 | −302.89 | 469.00 | 596.00 |
| BL non-myc | 78.02 | −201.94 | 47.60 | 38.88 |
| BL myc | 1.88 | 0.27 | 0.26 | 0.47 |
| PMBL | 571.94 | −1080.06 | 315.00 | 294.00 |
| MCL | 1610.08 | −916.92 | 582.00 | 412.00 |

The two Bayesian submodels can then be combined into the following single Bayesian score, $B_{BL}$:

$$B_{BL} = \begin{cases} B_{BLnon-myc} & \text{if } B_{BLmyc} > 0.1 \\ \min(B_{BLnon-myc}, 0.5) & \text{if } B_{BLmyc} \leq 0.1 \end{cases}.$$

The confidence values of each subtype can then be calculated as follows:

MCL confidence=$B_{MCL}$

BL confidence=$(B_{BL})(1-B_{MCL})$

PMBL confidence=$(B_{PMBL})(1-B_{BL})(1-B_{MCL})$

ABC confidence=$(B_{ABC/GCB})(1-B_{PMBL})(1-B_{BL})(1-B_{MCL})$

GCB confidence=$(1-B_{ABC/GCB})(1-B_{PMBL})(1-B_{BL})(1-B_{MCL})$.

A similar confidence value analysis can be performed to predict whether a subject already diagnosed with DLBCL has the germinal center B cell (GCB) subtype or the activated B cell (ABC) subtype using the 800 gene array. In this respect, the sample is assumed to be of non-PMBL DLBCL, so only a ABC/GCB Bayesian submodel is used which employs the following logic:

ABC confidence=$(B_{ABC/GCB})$

GCB confidence=$(1-B_{ABC/GCB})$.

In another embodiment, evaluating the likelihood that a particular DLBCL sample belongs to either the ABC subtype or the GCB subtype can involve calculating confidence values using the 20 gene array containing the genes set forth in Table 3. The confidence values can be calculated using the algorithms described above with respect to ABC DLBCL, GCB DLBCL, PMBL, BL, or MCL, but using a different set of model weights, housekeeping weights, and cut points. For example, the weights ($w_i$) associated with the 20 gene probe set for the particular submodel are set forth in Table 6. The $m_1$, $m_2$, $v_1$, and $v_2$ values for this model are, for example, 916.74, −449.76, 294.24, and 343.55, respectively.

The classification of a lymphoproliferative disorder in accordance with embodiments of the invention may be used in combination with any other effective classification feature or set of features. For example, a disorder may be classified by a method of the invention in conjunction with WHO suggested guidelines, morphological properties, histochemical properties, chromosomal structure, genetic mutation, cellular proliferation rates, immunoreactivity, clinical presentation, and/or response to chemical, biological, or other agents. Embodiments of the invention may be used in lieu of or in conjunction with other methods for lymphoma diagnosis, such as immunohistochemistry, flow cytometry, FISH for translocations, or viral diagnostics.

The inventive methods further comprise selecting a treatment option for the subject based on the subject's lymphoma classification. Accurate determination of lymphoma type in a subject allows for better selection and application of therapeutic methods. Knowledge about the exact lymphoma affecting a subject allows a clinician to select therapies or treatments that are most appropriate and useful for that subject, while avoiding therapies that are nonproductive or even counterproductive. For example, central nervous system (CNS) prophylaxis may be useful for treating BL but not DLBCL, CHOP therapy (cyclophosphamide, hydroxydaunorubicin, oncovin (vincristine), and prednisone) may be useful for treating DLBCL but not blastic MCL (see, e.g., Fisher et al., *N. Engl. J. Med.,* 328: 1002-1006 (1993); and Khouri et al., *J. Clin. Oncol.,* 12: 3803-3809 (1998)), and subjects with follicular lymphoma frequently receive treatment while subjects with follicular hyperplasia do not.

The treatment option selected can comprise any suitable therapeutic regimen or pharmaceutical agent that shows efficacy in treating the particular lymphoma type. For example, the current standard of care for the treatment of diffuse large B cell lymphoma (DLBCL) includes anthracycline-based chemotherapy regimens such as CHOP in combination with the administration of the anti-CD20 monoclonal antibody rituximab (RITUXAN™, Genentech, Inc., South San Francisco, Calif.) ("R-CHOP"), CODOX-M/IVAC therapy (cyclophosphamide, doxorubicin, vincristine, methotrexate/ifosfamide, etoposide, high dose cytarabine), CNS prophylaxis, and radiotherapy. In one embodiment, the invention comprises providing R-CHOP therapy to a GCB DLBCL subject, while providing a different therapy to an ABC DLBCL subject, as an ABC DLBCL diagnosis can have a worse prognosis in response to R-CHOP chemotherapy as compared to a GCB DLBCL diagnosis. In this embodiment, the ABC DLBCL subject can be provided with any of the treatment options described herein or otherwise known in the art to be effective against lymphoma.

Treatment options for MCL include, for example, chemotherapy (e.g., CHOP), immune based therapy (e.g., rituximab), radioimmunotherapy, and biologic agents (e.g., protoesome inhibitors and mTor inhibitors). Treatment options for BL include, for example, R-EPOCH therapy (i.e., rituximab, etoposide, prednisone, oncovirin (vincristine)-doxorubicin-cyclophosphamide), CODOX-M/IVAC therapy, immunotherapy, bone marrow transplantation, stem cell transplantation, surgery, and radiotherapy. Treatment options for PBML are similar to those for DLBCL, and also can include high-dose chemotherapy, radiotherapy, and/or stem cell transplantation. Other lymphoma treatments include drugs which target specific pathways that sustain lymphoma survival, such as, e.g., ibrutinib.

The following examples further illustrates the invention but, of course, should not be construed as in any way limiting its scope.

Example 1

This example demonstrates a method for determining subtypes of diffuse large B-cell lymphoma (DLBCL) using gene expression profiling on formalin-fixed paraffin embedded tissue.

Although the ABC DLBCL and GCB DLBCL subtypes were originally defined using gene expression profiling (GEP) on snap-frozen tissues (referred to herein as "frozen-GEP"), it has become common practice to use less precise but relatively inexpensive and broadly applicable immunohistochemical (IHC) methods using formalin-fixed paraffin embedded tissues (FFPET). The inventive method allows for a robust, highly accurate, molecular assay for cell-of-origin (COO) distinction using new GEP techniques applicable to FFPET. Studies were performed on centrally reviewed DLBCL FFPET biopsies from the Lymphoma/Leukemia Molecular Profiling Project (LLMPP) matching cases that had "gold standard" COO assigned by frozen-GEP using GENECHIP™ U133 plus 2.0 microarrays (Affymetrix, Santa Clara, Calif.). The training cohort consisted of 51 cases comprising 20 GCB DLBCL, 19 ABC DLBCL and 12 unclassifiable (U) cases. An independent validation cohort, which includes 68 cases (28 GCB DLBCL, 30 ABC DLBCL, and 10 U) drawn from the validation cohort described in Lenz et al., *N. Engl. J. Med.,* 359: 2313-2323 (2008), had the typical proportions of COO subtypes seen in DLBCL populations.

Nucleic acids were extracted from 10 μm FFPET scrolls. Digital gene expression was performed on 200 ng of RNA using the NANOSTRING™ assay (NanoString Technologies, Seattle, Wash.). All FFPET GEP studies were performed in parallel at two independent sites (BC Cancer Agency, Vancouver and NCI, Bethesda, Md.) using different FFPET scrolls to determine inter-site concordance, which assesses the robustness and portability of the assay. To assign COO by IHC, tissue microarrays were made using 0.6 mm duplicate cores for the validation cohort and stained for antibodies for CD10, BCL6, MUM1, FOXP1, GCET1, and LMO2. Two hematopathologists independently assessed the proportion of tumor cells stained, with consensus on discordant cases reached with a third hematopathologist. For the validation studies, those producing and analyzing the GEP and IHC data were blinded to the "gold standard" COO.

All 119 FFPET biopsies yielded sufficient RNA. A pilot study using the training cohort identified 20 genes (i.e., 15 genes of interest and 5 housekeeping genes) whose expression, measured using the NANOSTRING™ assay, would allow accurate replication of the COO assignment model described in Lenz et al., supra. The NANOSTRING™ assay was then used to quantify expression of these 20 genes in the training cohort, thereby allowing the COO model to be optimized. Despite the age of the FFPET blocks (6 to 32 years old), 95% (49/51) of the training samples produced gene expression data of sufficient quality. The COO model, including coefficients, thresholds, and QC parameters was then "locked" and applied to the independent validation cohort. Ninety-nine percent (67/68) of the samples from the validation cohort (5 to 12 years old) provided gene expression of adequate quality. When considering the "gold standard" ABC DLBCL and GCB DLBCL cases, the COO assignments by the NANOSTRING™ assay at the NCI site were 93% concordant, with 5% labeled U and 1 ABC misclassified as GCB, as shown in Table 8.

TABLE 8

|  |  | NANOSTRING™ GEP Assay - NCI | | | Hans Algorithm | | Tally Algorithm | | Choi Algorithm | |
| --- | --- | --- | --- | --- | --- | --- | --- | --- | --- | --- |
|  |  | GCB | U | ABC | GCB | Non-GCB | GCB | ABC | GCB | ABC |
| Frozen-GEP | GCB | 28 | 0 | 0 | 21 | 0 | 18 | 3 | 19 | 2 |
|  | U | 7 | 2 | 1 | 5 | 5 | 2 | 8 | 6 | 4 |
|  | ABC | 1 | 3 | 25 | 4 | 22 | 0 | 26 | 6 | 20 |

Thus, 119 highly characterized DLBCL cases from the LLMPP, which were previously subtyped by a published disease-defining algorithm using frozen-GEP, were highly accurately analyzed in accordance with the inventive method. These results demonstrate that the inventive method, which utilized RNA from FFPET that is routinely obtained for diagnosis, provides a desirable alternative to existing techniques for the analysis of DLBCL cases. The 2% rate of misclassification of ABC and GCB cases by the inventive method compares favorably with the 9%, 6% and 17% rates for the Hans, Tally and Choi algorithms, respectively (see Hans et al. *Blood,* 103(1): 275-82 (2004); Meyer et al., *J. Clin. Oncol.,* 29(2): 200-207 (2011); and Choi et al., *Clin. Cancer Res.,* 15(17): 5494-502 (2009)). Furthermore, the 100% concordance of COO assignment (95% if "gold standard" U cases also are included) between the NCI and BC Cancer Agency sites indicates that, in contrast to the IHC algorithms, the inventive method is robust.

The inventive method exhibits high performance with archival FFPET and allows for rapid turn-around time (<36 hours from FFPET block to result), which is highly desirable in clinical practice.

Example 2

This example demonstrates a method for determining subtypes of aggressive B cell non-Hodgkin lymphomas (agg-B-NHL) using gene expression profiling on formalin-fixed paraffin embedded tissue.

Formalin-fixed, paraffin-embedded tissue (FFPET) biopsies qualified by an expert Hematopathology review panel as having a tumor content of ≥60% and confirmed B cell immunophenotype were evaluated. Diagnostic categories included diffuse large B cell lymphoma (DLBCL) including the activated B cell-like (ABC) and germinal center B cell-like (GCB) subtypes, unclassifiable (UNC) DLBCL, primary mediastinal B cell lymphoma (PMBCL), Burkitt lymphoma (BL), and mantle cell lymphoma (MCL). Using previous GEP data, diagnostic signatures, the NCOUNTER™ gene expression assay (NanoString Technologies, Seattle, Wash.), and employing published procedures (Scott et al, *Blood*, (January 2014); DOI: 10.1182/blood-2013-11-536433), probes to 800 genes (shown in Table 4) were designed with utility in distinguishing between these pathological entities.

The training cohort comprised 107 unique cases, whose FFPET biopsies were independently assayed at the Molecular Characterization Laboratory, Frederick National Laboratory for Cancer Research (Frederick, Md.) and the Centre for Lymphoid Cancer, BC Cancer Agency (Vancouver, BC). The resulting algorithm was locked down and applied to an independent cohort of 199 cases. The nucleic acids from FFPET biopsies from these cases were extracted and run across the two independent laboratories, with 83 cases run at both laboratories to assess inter-laboratory performance. The "gold standard" by which the NANOSTRING™ classification was compared was based on Affymetrix gene expression profiling of matched frozen biopsies in the cases of ABC, GCB, and UNC DLBCL (Lenz et al., supra) and on the pathological diagnosis by the Hematopathology review panel in the cases of BL, MCL, and PMBCL. The use of human tissues and clinical data for this study was approved by the University of Arizona Institutional Review Board in accordance with the Declaration of Helsinki.

The final locked algorithm consisted of 297 gene probes (shown in Table 2) including 47 housekeeping genes. Thirty-six cases from the training cohort were run again on the new lot of NANOSTRING™ code set to allow for cross code set calibration of the assay. The laboratory procedure and algorithm, together termed the "Lymph5Cx" test, consists of a hierarchical series of pair-wise comparisons. In the independent validation set, 257/282 (91.1%) of assays yielded gene expression data of sufficient quality (total of 185 of the 199 cases). A classification summary is given in Table 9.

TABLE 9

| Lymphoma Subtype | # cases | % accurate | % borderline | % error |
|---|---|---|---|---|
| ABC | 26 | 76.9% | 23.1% | 0.0% |
| GCB | 27 | 88.9% | 7.4% | 3.7% |
| BL | 48 | 68.8% | 19.8% | 11.5% |
| PMBL | 30 | 80.0% | 6.7% | 13.3% |
| MCL | 34 | 100.0% | 0.0% | 0.0% |

In this cohort, 136 cases (82%) were correctly assigned while 12 cases (6%) were assigned incorrect diagnoses as follows: 6 BL assigned to GCB, 1 GCB labeled a PMBCL, 1 UNC DLBCL called a PMBCL and 4 PMBCL assigned to DLBCL subtypes. The Lymph5Cx test included categories of indeterminate results between two diagnostic entities and were declared borderline. The agreement between the two laboratory sites was 71/72 (99%) of cases that yielded adequate gene expression data at both sites.

Therefore, the results of this example demonstrate that the Lymph5Cx test was robust and able to discriminate the often clinically difficult diagnostic categories of agg-B-NHL using a single methodology for cases with histologic and immunophenotypic features of an agg-B-NHL. Misclassification errors were low, suggesting that this test would be useful adjunct to current diagnostic methods. In addition, targetable pathways, as well as genes associated with known prognostic signatures in DLBCL (stromal) and MCL (proliferation) were quantified.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and "at least one" and similar referents in the context of describing the invention (especially in the context of the following claims) are to be construed to cover both the singular and the plural, unless otherwise indicated herein or clearly contradicted by context. The use of the term "at least one" followed by a list of one or more items (for example, "at least one of A and B") is to be construed to mean one item selected from the listed items (A or B) or any combination of two or more of the listed items (A and B), unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should

SEQUENCE LISTING (2460 sequences)

SEQ ID NO: 1 - DNA, 100 bp, Artificial Sequence
  Synthetic
ctggcatattgactggacgtggcaaaacaaatcagaacacaggaatgaccctcccggcacagaagtgtatattggatgcattcaaagccagtggagatca

SEQ ID NO: 2 - DNA, 50 bp, Artificial Sequence
  Synthetic
ggtcattcctgtgttctgatttgttttgccacgtccagtcaatatgccag

SEQ ID NO: 3 - DNA, 50 bp, Artificial Sequence
  Synthetic
tgatctccactggctttgaatgcatccaatatacacttctgtgccgggag

SEQ ID NO: 4 - DNA, 100 bp, Artificial Sequence
  Synthetic
ggtggcctgagttcagcaaatttggaggttttgacccgcagggtgcactgagaaacatggctgtggcaaaacacaacttgaacatcatgattaaacgcta

SEQ ID NO: 5 - DNA, 50 bp, Artificial Sequence
  Synthetic
cagtgcaccctgcgggtcaaaacctccaaatttgctgaactcaggccacc

SEQ ID NO: 6 - DNA, 50 bp, Artificial Sequence
  Synthetic
tagcgtttaatcatgatgttcaagttgtgttttgccacagccatgtttct

SEQ ID NO: 7 - DNA, 100 bp, Artificial Sequence
  Synthetic
acgactgaacacaatcaactgtgaggaaggagataaactgaaactcaccagctttgaattggcaccgaaaagtgggaataccggggagttgagatctgta

SEQ ID NO: 8 - DNA, 50 bp, Artificial Sequence
  Synthetic
tggtgagtttcagtttatctccttcctcacagttgattgtgttcagtcgt

SEQ ID NO: 9 - DNA, 50 bp, Artificial Sequence
  Synthetic
tacagatctcaactccccggtattcccacttttcggtgccaattcaaagc

SEQ ID NO: 10 - DNA, 100 bp, Artificial Sequence
  Synthetic
ctaatcagctctcagtgatcaacccactcttgttatgggtggtctctgtcactttgaatgccaggctggcttctcgtctagcagtattcagatacccctt

SEQ ID NO: 11 - DNA, 50 bp, Artificial Sequence
  Synthetic
gacagagaccacccataacaagagtgggttgatcactgagagctgattag

SEQ ID NO: 12 - DNA, 50 bp, Artificial Sequence
  Synthetic
aaggggtatctgaatactgctagacgagaagccagcctggcattcaaagt

SEQ ID NO: 13 - DNA, 100 bp, Artificial Sequence
  Synthetic
aaataccacaagatcattttgtgacctcacagatgagtggagaagcacacacgaggcctatgtcaccgtcctagaaggattcagcgggaacacaacgttg

SEQ ID NO: 14 - DNA, 50 bp, Artificial Sequence
  Synthetic
gtgtgcttctccactcatctgtgaggtcacaaaatgatcttgtggtattt

SEQ ID NO: 15 - DNA, 40 bp, Artificial Sequence
  Synthetic
ttcccgctgaatccttctaggacggtgacataggcctcgt

SEQ ID NO: 16 - DNA, 100 bp, Artificial Sequence
  Synthetic
acagacttacaggttacctccgaaactgaagatctcctagcctgtgcctctgggactggacaattgcttcaagcattcttcaaccagcagatgctgttta

SEQ ID NO: 17 - DNA, 50 bp, Artificial Sequence
  Synthetic
gaggcacaggctaggagatcttcagtttcggaggtaacctgtaagtctgt

SEQ ID NO: 18 - DNA, 50 bp, Artificial Sequence
  Synthetic
taaacagcatctgctggttgaagaatgcttgaagcaattgtccagtccca

SEQ ID NO: 19 - DNA, 100 bp, Artificial Sequence
  Synthetic
tttctttctgatgtcaaaaatgtcttgggtaggcgggaaggagggttagggaggggtaaaattccttagcttagacctcagcctgtgctgcccgtcttca

SEQ ID NO: 20 - DNA, 50 bp, Artificial Sequence
  Synthetic
cctaaccctccttcccgcctacccaagacatttttgacatcagaaagaaa

SEQ ID NO: 21 - DNA, 50 bp, Artificial Sequence
  Synthetic
tgaagacgggcagcacaggctgaggtctaagctaaggaattttacccctc

SEQ ID NO: 22 - DNA, 100 bp, Artificial Sequence
  Synthetic
ctgccctcaaccgcaaagaagggttgcgtttagcagaggaccggagcaaggaccctcacgacccacataaaatctacgagtttgtgaactcaggagttgg

SEQ ID NO: 23 - DNA, 45 bp, Artificial Sequence
  Synthetic
cttgctccggtcctctgctaaacgcaacccttctttgcggttgag

SEQ ID NO: 24 - DNA, 50 bp, Artificial Sequence
  Synthetic
ccaactcctgagttcacaaactcgtagattttatgtgggtcgtgagggtc

SEQ ID NO: 25 - DNA, 100 bp, Artificial Sequence
  Synthetic
gcctggctctcgggaaattcagccatgagcagggaaagaactctcccaaccctggggcctagctgtataggaggaattgcctaagggtggcccactcttg

SEQ ID NO: 26 - DNA, 48 bp, Artificial Sequence
  Synthetic
gttgggagagttctttccctgctcatggctgaatttcccgagagccag

SEQ ID NO: 27 - DNA, 35 bp, Artificial Sequence
  Synthetic
cttaggcaattcctcctatacagctaggccccagg

SEQ ID NO: 28 - DNA, 100 bp, Artificial Sequence
  Synthetic
cgcagcgtgagggtgtgtcttccctggatagcagcagcctcagcctctgcctgtccagcgccaacagcctctatgacgacatcgagtgcttccttatgga

SEQ ID NO: 29 - DNA, 38 bp, Artificial Sequence
  Synthetic
gcagaggctgaggctgctgctatccagggaagacacac

SEQ ID NO: 30 - DNA, 50 bp, Artificial Sequence
  Synthetic
tccataaggaagcactcgatgtcgtcatagaggctgttggcgctggacag

SEQ ID NO: 31 - DNA, 100 bp, Artificial Sequence
  Synthetic
taccagcgatttctagacctgggcatctccattgctgaaaaccgcagtgccttcagctaccattgcaagaccccagattgcaagggatggtgcttctttg

SEQ ID NO: 32 - DNA, 45 bp, Artificial Sequence
  Synthetic
gcactgcggttttcagcaatggagatgcccaggtctagaaatcgc

SEQ ID NO: 33 - DNA, 50 bp, Artificial Sequence
  Synthetic
caaagaagcaccatcccttgcaatctggggtcttgcaatggtagctgaag

SEQ ID NO: 34 - DNA, 100 bp, Artificial Sequence
  Synthetic
acctcaccgatgacacacagttgctcagctacttctctacccttgacatccagcttcgcgagagcctagagccagatgcctatgcgttgttccataagaa

SEQ ID NO: 35 - DNA, 48 bp, Artificial Sequence
  Synthetic
gatgtcaagggtagagaagtagctgagcaactgtgtgtcatcggtgag

SEQ ID NO: 36 - DNA, 50 bp, Artificial Sequence
  Synthetic
ttcttatggaacaacgcataggcatctggctctaggctctcgcgaagctg

SEQ ID NO: 37 - DNA, 100 bp, Artificial Sequence
  Synthetic
tctcagagctcggtttcccgccagccgtgcaacgctgggtcatcggacggtgcctgtgtgtgcctgagcgcagccttgcctcttacggggttcggcagga

SEQ ID NO: 38 - DNA, 40 bp, Artificial Sequence
  Synthetic
ccgtccgatgacccagcgttgcacggctggcgggaaaccg

SEQ ID NO: 39 - DNA, 38 bp, Artificial Sequence
  Synthetic
ccgtaagaggcaaggctgcgctcaggcacacacaggca

SEQ ID NO: 40 - DNA, 100 bp, Artificial Sequence
  Synthetic
gtcacttgtatggtccccagggtgggagccccatcctgttctatggaataaagcgtcgcctctctgcctcgaaccagtcaaatggagtattgcggctgca

SEQ ID NO: 41 - DNA, 50 bp, Artificial Sequence
  Synthetic
tattccatagaacaggatggggctcccaccctggggaccatacaagtgac

SEQ ID NO: 42 - DNA, 47 bp, Artificial Sequence
  Synthetic
agccgcaatactccatttgactggttcgaggcagagaggcgacgctt

SEQ ID NO: 43 - DNA, 100 bp, Artificial Sequence
  Synthetic
gtgagtatgaggaatttagcctcttatagtgaaatgagtccaactctgggctttgcttagaggagagctcctgtcaggcttcctataatatgaaaagaag

SEQ ID NO: 44 - DNA, 50 bp, Artificial Sequence
  Synthetic
cccagagttggactcatttcactataagaggctaaattcctcatactcac

SEQ ID NO: 45 - DNA, 50 bp, Artificial Sequence
  Synthetic
cttcttttcatattataggaagcctgacaggagctctcctctaagcaaag

SEQ ID NO: 46 - DNA, 100 bp, Artificial Sequence
  Synthetic
agcaaggcacgaagtaccaattactacccacctccatctgataattgtcagcatcgattcaactcggtgcacggctcttgcttctgcttcccagcaaagt

SEQ ID NO: 47 - DNA, 50 bp, Artificial Sequence
  Synthetic
tgacaattatcagatggaggtgggtagtaattggtacttcgtgccttgct

SEQ ID NO: 48 - DNA, 50 bp, Artificial Sequence
  Synthetic
actttgctgggaagcagaagcaagagccgtgcaccgagttgaatcgatgc

SEQ ID NO: 49 - DNA, 100 bp, Artificial Sequence
  Synthetic
ttttcctctaacatcgagcctgaacctaaagatctcacagtcggggttgccctgcatggggtcacaaagatctatggctcaaaagttgctgttgataacc

SEQ ID NO: 50 - DNA, 50 bp, Artificial Sequence
  Synthetic
gcaaccccgactgtgagatctttaggttcaggctcgatgttagaggaaaa

SEQ ID NO: 51 - DNA, 50 bp, Artificial Sequence
  Synthetic
ggttatcaacagcaacttttgagccatagatctttgtgaccccatgcagg

SEQ ID NO: 52 - DNA, 100 bp, Artificial Sequence
  Synthetic
cagatggcgctagatgtttacaacggactccttcctccctatgcttcttgccacttgacggaattgtactttgagaagggggagtactttgtggagatgt

SEQ ID NO: 53 - DNA, 50 bp, Artificial Sequence
  Synthetic
caagaagcatagggaggaaggagtccgttgtaaacatctagcgccatctg

SEQ ID NO: 54 - DNA, 50 bp, Artificial Sequence
  Synthetic
acatctccacaaagtactcccccttctcaaagtacaattccgtcaagtgg

SEQ ID NO: 55 - DNA, 100 bp, Artificial Sequence
  Synthetic
tctgtgacacaccccaaaaggcattggtgctgatagggaatgtagagaaaggcttcaccccgagcctgaaggtgatcatccttatggacccctttgatga

SEQ ID NO: 56 - DNA, 50 bp, Artificial Sequence
  Synthetic
tttctctacattccctatcagcaccaatgccttttggggtgtgtcacaga

SEQ ID NO: 57 - DNA, 38 bp, Artificial Sequence
  Synthetic
tccataaggatgatcaccttcaggctcggggtgaagcc

SEQ ID NO: 58 - DNA, 100 bp, Artificial Sequence
  Synthetic
gggccctccattgtccacaggaagtgcttctaaagtcagaacaggttctccaaggatcccctcgagactactctgttaccagtcatgaaacattaaaacc

SEQ ID NO: 59 - DNA, 48 bp, Artificial Sequence
  Synthetic
gagaacctgttctgactttagaagcacttcctgtggacaatggagggc

SEQ ID NO: 60 - DNA, 50 bp, Artificial Sequence
  Synthetic
ggttttaatgtttcatgactggtaacagagtagtctcgaggggatccttg

SEQ ID NO: 61 - DNA, 100 bp, Artificial Sequence
  Synthetic
gtactgatgtctccctcgctcgaaattacacggtaattctgggtcactgttactaccatggacatgtacggggatattctgattcagcagtcagtctcag

SEQ ID NO: 62 - DNA, 50 bp, Artificial Sequence
  Synthetic
acagtgacccagaattaccgtgtaatttcgagcgagggagacatcagtac

SEQ ID NO: 63 - DNA, 50 bp, Artificial Sequence
  Synthetic
ctgagactgactgctgaatcagaatatccccgtacatgtccatggtagta

SEQ ID NO: 64 - DNA, 100 bp, Artificial Sequence
  Synthetic
gcagagtggatgacacactcattccctgcaaagcaaatgataccatgtgtgggaagttgttctgtcaaggtgggtcggataatttgccctggaaaggacg

SEQ ID NO: 65 - DNA, 50 bp, Artificial Sequence
  Synthetic
acacatggtatcatttgctttgcagggaatgagtgtgtcatccactctgc

SEQ ID NO: 66 - DNA, 50 bp, Artificial Sequence
  Synthetic
cgtcctttccagggcaaattatccgacccaccttgacagaacaacttccc

SEQ ID NO: 67 - DNA, 100 bp, Artificial Sequence
  Synthetic
ataatctttagtcatcgaatcccagtggaggggacccttttacttgccctgaacatacacatgctgggccattgtgattgaagtcttctaactctgtctc

SEQ ID NO: 68 - DNA, 50 bp, Artificial Sequence
  Synthetic
agggcaagtaaaagggtcccctccactgggattcgatgactaaagattat

SEQ ID NO: 69 - DNA, 50 bp, Artificial Sequence
  Synthetic
gagacagagttagaagacttcaatcacaatggcccagcatgtgtatgttc

SEQ ID NO: 70 - DNA, 100 bp, Artificial Sequence
  Synthetic
gctttcttctctaccatgacaccaactgatcaccactaactcagagcctcctccaggccaaacagccccaaagtcaattaaaggctttcagtacggttag

SEQ ID NO: 71 - DNA, 49 bp, Artificial Sequence
  Synthetic
gaggctctgagttagtggtgatcagttggtgtcatggtagagaagaaag

SEQ ID NO: 72 - DNA, 50 bp, Artificial Sequence
  Synthetic
ctaaccgtactgaaagcctttaattgactttggggctgtttggcctggag

SEQ ID NO: 73 - DNA, 100 bp, Artificial Sequence
  Synthetic
aggaactttaatgttcccgactcgggtgattccagctgtgttgctggcagtgttgtctcaaccctctccctaaaatgactgagccctgggttcatctaat

SEQ ID NO: 74 - DNA, 50 bp, Artificial Sequence
  Synthetic
ctgccagcaacacagctggaatcacccgagtcgggaacattaaagttcct

SEQ ID NO: 75 - DNA, 50 bp, Artificial Sequence
  Synthetic
attagatgaacccagggctcagtcattttagggagagggttgagacaaca

SEQ ID NO: 76 - DNA, 100 bp, Artificial Sequence
  Synthetic
cacgcatgatcaccaaaaccttcccatcctgattctcttcttctacctctaccctctccaacttctcctggtcttcacatatactctcaaagctagtctg

SEQ ID NO: 77 - DNA, 50 bp, Artificial Sequence
  Synthetic
agaggtagaagaagagaatcaggatgggaaggttttggtgatcatgcgtg

SEQ ID NO: 78 - DNA, 50 bp, Artificial Sequence
  Synthetic
cagactagctttgagagtatatgtgaagaccaggagaagttggagagggt

SEQ ID NO: 79 - DNA, 100 bp, Artificial Sequence
  Synthetic
ctgctaccacatccactctaagcaaggactctctcaatcctagttccctcctggctgccatgatgcaacaagatgagtctatttatctctatcctgcttc

SEQ ID NO: 80 - DNA, 50 bp, Artificial Sequence
  Synthetic
gagggaactaggattgagagagtccttgcttagagtggatgtggtagcag

SEQ ID NO: 81 - DNA, 50 bp, Artificial Sequence
  Synthetic
gaagcaggatagagataaatagactcatcttgttgcatcatggcagccag

SEQ ID NO: 82 - DNA, 100 bp, Artificial Sequence
  Synthetic
gctgcatgaaaattcagttcgtctctccagacagcttcggcgcatccttttgcccctgtatgaggttgatgacttacgagacgcatttcgtactttggga

SEQ ID NO: 83 - DNA, 50 bp, Artificial Sequence
  Synthetic
aaaggatgcgccgaagctgtctggagagacgaactgaattttcatgcagc

SEQ ID NO: 84 - DNA, 50 bp, Artificial Sequence
  Synthetic
tcccaaagtacgaaatgcgtctcgtaagtcatcaacctcatacaggggca

SEQ ID NO: 85 - DNA, 100 bp, Artificial Sequence
  Synthetic
gcttgagccagggtgcacgcaggaatctgtctggaaaaaggcagttctcactgaggaggtttgaggcgcgcgctctgggcaggaagcctccccagctttc

SEQ ID NO: 86 - DNA, 49 bp, Artificial Sequence
  Synthetic
tgagaactgcctttttccagacagattcctgcgtgcaccctggctcaag

SEQ ID NO: 87 - DNA, 35 bp, Artificial Sequence
  Synthetic
ttcctgcccagagcgcgcgcctcaaacctcctcag

SEQ ID NO: 88 - DNA, 100 bp, Artificial Sequence
  Synthetic
ctgggaagcagcatgagattgaagagctaaacagagagctggaagaaatgagggttacctatgggactgaaggactgcagcagttacaagaatttgaagc

SEQ ID NO: 89 - DNA, 50 bp, Artificial Sequence
  Synthetic
catttcttccagctctctgtttagctcttcaatctcatgctgcttcccag

SEQ ID NO: 90 - DNA, 50 bp, Artificial Sequence
  Synthetic
gcttcaaattcttgtaactgctgcagtccttcagtcccataggtaaccct

SEQ ID NO: 91 - DNA, 100 bp, Artificial Sequence
  Synthetic
acatactgcatcctatagttataccatccactctgaaatcaatgtgaatttaacttcagttccatacagaaacttcttttccacaggtaagaaacggttg

SEQ ID NO: 92 - DNA, 50 bp, Artificial Sequence
  Synthetic
aattcacattgatttcagagtggatggtataactataggatgcagtatgt

SEQ ID NO: 93 - DNA, 50 bp, Artificial Sequence
  Synthetic
caaccgtttcttacctgtggaaaagaagtttctgtatggaactgaagtta

SEQ ID NO: 94 - DNA, 100 bp, Artificial Sequence
  Synthetic
gtcaagatcagcaacactatttctgagcgggtcatgaatcactggcaggaagacctgatgtttggctaccagttcctgaatggctgcaaccctgtgttga

SEQ ID NO: 95 - DNA, 50 bp, Artificial Sequence
  Synthetic
tcctgccagtgattcatgacccgctcagaaatagtgttgctgatcttgac

SEQ ID NO: 96 - DNA, 50 bp, Artificial Sequence
  Synthetic
tcaacacagggttgcagccattcaggaactggtagccaaacatcaggtct

SEQ ID NO: 97 - DNA, 100 bp, Artificial Sequence
  Synthetic
tttcgtgcgcttggctttattcatgaggctcaggtcggggaaagactgatggtccactgtgacagcaagacaggtaatgcaaatacggatttcatctggg

SEQ ID NO: 98 - DNA, 50 bp, Artificial Sequence
  Synthetic
atcagtctttccccgacctgagcctcatgaataaagccaagcgcacgaaa

SEQ ID NO: 99 - DNA, 49 bp, Artificial Sequence
  Synthetic
ccagatgaaatccgtatttgcattacctgtcttgctgtcacagtggacc

SEQ ID NO: 100 - DNA, 100 bp, Artificial Sequence
  Synthetic
gccaaactgcgcgtcgatatcacattgctgggatttgaaaacatgagctggataagagggaggcgtagttttatatttaagggagaagacaactgggcgg

SEQ ID NO: 101 - DNA, 50 bp, Artificial Sequence
  Synthetic
cagctcatgttttcaaatcccagcaatgtgatatcgacgcgcagtttggc

SEQ ID NO: 102 - DNA, 50 bp, Artificial Sequence
  Synthetic
ccgcccagttgtcttctcccttaaatataaaactacgcctccctcttatc

SEQ ID NO: 103 - DNA, 100 bp, Artificial Sequence
  Synthetic
atgacctcttcagtgatgtcctagaggaaggtgaactagatatggagaagagccaagaggagatggatcaagcattagcagaaagcagcgaagaacagga

SEQ ID NO: 104 - DNA, 50 bp, Artificial Sequence
  Synthetic
cttctccatatctagttcaccttcctctaggacatcactgaagaggtcat

SEQ ID NO: 105 - DNA, 48 bp, Artificial Sequence
  Synthetic
ctgttcttcgctgctttctgctaatgcttgatccatctcctcttggct

SEQ ID NO: 106 - DNA, 100 bp, Artificial Sequence
  Synthetic
acgcttactcaaagagcttgagccagtctacttccctcttccagtcaaccgagagtgaatctcaggctcccacatctataaccttaatctccactgacaa

SEQ ID NO: 107 - DNA, 50 bp, Artificial Sequence
  Synthetic
ggttgactggaagagggaagtagactggctcaagctctttgagtaagcgt

SEQ ID NO: 108 - DNA, 50 bp, Artificial Sequence
  Synthetic
ttgtcagtggagattaaggttatagatgtgggagcctgagattcactctc

SEQ ID NO: 109 - DNA, 100 bp, Artificial Sequence
  Synthetic
gatgggggtccagcctgctacggcggatttgacctgtacttcattttggacaaatcaggaagtgtgctgcaccactggaatgaaatctattactttgtgg

SEQ ID NO: 110 - DNA, 50 bp, Artificial Sequence
  Synthetic
tccaaaatgaagtacaggtcaaatccgccgtagcaggctggacccccatc

SEQ ID NO: 111 - DNA, 50 bp, Artificial Sequence
  Synthetic
ccacaaagtaatagatttcattccagtggtgcagcacacttcctgatttg

SEQ ID NO: 112 - DNA, 100 bp, Artificial Sequence
  Synthetic
tgtaccttgaagctagttttggctatgcgtggcggacctataaatactagaagagttcctacagacgatccacttaggaagatggcagagtacttggatt

SEQ ID NO: 113 - DNA, 50 bp, Artificial Sequence
  Synthetic
ctagtatttataggtccgccacgcatagccaaaactagcttcaaggtaca

SEQ ID NO: 114 - DNA, 50 bp, Artificial Sequence
  Synthetic
aatccaagtactctgccatcttcctaagtggatcgtctgtaggaactctt

SEQ ID NO: 115 - DNA, 100 bp, Artificial Sequence
  Synthetic
ccgctttgaccgggattaccagcagtaccatggactacggaaagaagtggtggacacaagcccaagcccacgacctggtcatcaaaagccttgacaaatt

SEQ ID NO: 116 - DNA, 47 bp, Artificial Sequence
  Synthetic
ccacttctttccgtagtccatggtactgctggtaatcccggtcaaag

SEQ ID NO: 117 - DNA, 50 bp, Artificial Sequence
  Synthetic
aatttgtcaaggcttttgatgaccaggtcgtgggcttgggcttgtgtcca

SEQ ID NO: 118 - DNA, 100 bp, Artificial Sequence
  Synthetic
agaatttaataaaacaggggaaaaccaaggaacacttgaatttctcaggttttggacattcagagagatgaattgtgagaacagcaaagaaatccatcag

SEQ ID NO: 119 - DNA, 50 bp, Artificial Sequence
  Synthetic
acctgagaaattcaagtgttccttggttttcccctgttttattaaattct

SEQ ID NO: 120 - DNA, 50 bp, Artificial Sequence
  Synthetic
ctgatggatttctttgctgttctcacaattcatctctctgaatgtccaaa

SEQ ID NO: 121 - DNA, 100 bp, Artificial Sequence
  Synthetic
gggcccatttgaaggtgtctcagacatttggccagtatgtctttctcaggggtttggtcacaaaggatggactcttcccacccagaggatgcagggaaag

SEQ ID NO: 122 - DNA, 50 bp, Artificial Sequence
  Synthetic
cctgagaaagacatactggccaaatgtctgagacaccttcaaatgggccc

SEQ ID NO: 123 - DNA, 40 bp, Artificial Sequence
  Synthetic
atcctctgggtgggaagagtccatcctttgtgaccaaacc

SEQ ID NO: 124 - DNA, 100 bp, Artificial Sequence
  Synthetic
cagcagggcctggcctctgggtcttctgtgtcctttgtgggtgccagcggctgtcctgaggcctacaagcggctcctatccagcttctactgcaagggga

SEQ ID NO: 125 - DNA, 42 bp, Artificial Sequence
  Synthetic
ccgctggcacccacaaaggacacagaagacccagaggccagg

SEQ ID NO: 126 - DNA, 39 bp, Artificial Sequence
  Synthetic
tagaagctggataggagccgcttgtaggcctcaggacag

SEQ ID NO: 127 - DNA, 100 bp, Artificial Sequence
  Synthetic
gaccatgatcgtttcccttgctgcggttgcttgggtgggacaacaagtccacaacctgcttctcacctacctgatagtgacttccttactattgcttcct

SEQ ID NO: 128 - DNA, 48 bp, Artificial Sequence
  Synthetic
ggacttgttgtcccacccaagcaaccgcagcaagggaaacgatcatgg

SEQ ID NO: 129 - DNA, 50 bp, Artificial Sequence
  Synthetic
aggaagcaatagtaaggaagtcactatcaggtaggtgagaagcaggttgt

SEQ ID NO: 130 - DNA, 100 bp, Artificial Sequence
  Synthetic
cgggctcaaagctggattagaaaggggagaggcacttgtgactttgtttgactctgtgactcacttcctcgctcacaccttgtttgaactactggacttt

SEQ ID NO: 131 - DNA, 50 bp, Artificial Sequence
  Synthetic
caaacaaagtcacaagtgcctctcccctttctaatccagctttgagcccg

SEQ ID NO: 132 - DNA, 50 bp, Artificial Sequence
  Synthetic
aaagtccagtagttcaaacaaggtgtgagcgaggaagtgagtcacagagt

SEQ ID NO: 133 - DNA, 100 bp, Artificial Sequence
  Synthetic
gccacggtggtgctggctagagtgtatacgtttggacccaagcttaacttttccaatgtggaatcctgggccttcattggttccgatgtcataggaatct

SEQ ID NO: 134 - DNA, 49 bp, Artificial Sequence
  Synthetic
aagttaagcttgggtccaaacgtatacactctagccagcaccaccgtgg

SEQ ID NO: 135 - DNA, 50 bp, Artificial Sequence
  Synthetic
agattcctatgacatcggaaccaatgaaggcccaggattccacattggaa

SEQ ID NO: 136 - DNA, 100 bp, Artificial Sequence
  Synthetic
ggacacgtaggcggtaccactaaggttttggtaatgagccattcaaaccgacagcagtgtgaaggtgtgtcaaggtgtatattctcgtggctcggcattc

SEQ ID NO: 137 - DNA, 50 bp, Artificial Sequence
  Synthetic
cggtttgaatggctcattaccaaaaccttagtggtaccgcctacgtgtcc

SEQ ID NO: 138 - DNA, 50 bp, Artificial Sequence
  Synthetic
gaatgccgagccacgagaatatacaccttgacacaccttcacactgctgt

SEQ ID NO: 139 - DNA, 100 bp, Artificial Sequence
  Synthetic
cggggggcaccaacacttggagatttttccggaggggagaggattttctaagggcacagagaatccattttctacacattaacttgagctgctggaggga

SEQ ID NO: 140 - DNA, 47 bp, Artificial Sequence
  Synthetic
tagaaaatcctctcccctccggaaaaatctccaagtgttggtgcccc

SEQ ID NO: 141 - DNA, 48 bp, Artificial Sequence
  Synthetic
cctccagcagctcaagttaatgtgtagaaaatggattctctgtgccct

SEQ ID NO: 142 - DNA, 100 bp, Artificial Sequence
  Synthetic
ggaagttctccttcaagtctaacctaaggccacactgtgacggctctcgggtcagttccttccgtgacctcggcaccgtggatgcccatgaatgctgatc

SEQ ID NO: 143 - DNA, 40 bp, Artificial Sequence
  Synthetic
ccgagagccgtcacagtgtggccttaggttagacttgaag

SEQ ID NO: 144 - DNA, 44 bp, Artificial Sequence
  Synthetic
cattcatgggcatccacggtgccgaggtcacggaaggaactgac

SEQ ID NO: 145 - DNA, 100 bp, Artificial Sequence
  Synthetic
cagagatggtacagggcgtacaagactcttcatgatacaagaacacattttttgaagacaaaggcagctgtgatttccctccagtctgcttatcgtggct

SEQ ID NO: 146 - DNA, 50 bp, Artificial Sequence
  Synthetic
aaatgtgttcttgtatcatgaagagtcttgtacgccctgtaccatctctg

SEQ ID NO: 147 - DNA, 50 bp, Artificial Sequence
  Synthetic
agccacgataagcagactggagggaaatcacagctgcctttgtcttcaaa

SEQ ID NO: 148 - DNA, 100 bp, Artificial Sequence
  Synthetic
tttgatatacatgctcaaccttcatcggcccacgtgtattgtccgggctcagaatgggaggactccagaagatgagagaaacctctttatccaacagata

SEQ ID NO: 149 - DNA, 50 bp, Artificial Sequence
  Synthetic
gagcccggacaatacacgtgggccgatgaaggttgagcatgtatatcaaa

SEQ ID NO: 150 - DNA, 50 bp, Artificial Sequence
  Synthetic
tatctgttggataaagaggtttctctcatcttctggagtcctcccattct

SEQ ID NO: 151 - DNA, 100 bp, Artificial Sequence
  Synthetic
acgctaagtcgctggccattggtggacatggcgcaggcgcgtttgctccgacgggccgaatgttttggggcagtgttttgagcgcggagaccgcgtgata

SEQ ID NO: 152 - DNA, 35 bp, Artificial Sequence
  Synthetic
cggagcaaacgcgcctgcgccatgtccaccaatgg

SEQ ID NO: 153 - DNA, 43 bp, Artificial Sequence
  Synthetic
cggtctccgcgctcaaaacactgccccaaaacattcggcccgt

SEQ ID NO: 154 - DNA, 100 bp, Artificial Sequence
  Synthetic
ggcatcctgaggaacttgatagacaaacaatgacagtgttttccagaactgtgggtacgtgtctaatctcagatggtactatgaattcctggagatcaaa

SEQ ID NO: 155 - DNA, 50 bp, Artificial Sequence
  Synthetic
agttctggaaaacactgtcattgtttgtctatcaagttcctcaggatgcc

SEQ ID NO: 156 - DNA, 50 bp, Artificial Sequence
  Synthetic
tttgatctccaggaattcatagtaccatctgagattagacacgtacccac

SEQ ID NO: 157 - DNA, 100 bp, Artificial Sequence
  Synthetic
gacatgctctacagtgctcagtctttgaggtcacgagaagagaatgccttctagatgcaaaatcacctccaaaccagaccacttttcttgacttgcctgt

SEQ ID NO: 158 - DNA, 50 bp, Artificial Sequence
  Synthetic
aaggcattctcttctcgtgacctcaaagactgagcactgtagagcatgtc

SEQ ID NO: 159 - DNA, 50 bp, Artificial Sequence
  Synthetic
acaggcaagtcaagaaaagtggtctggtttggaggtgattttgcatctag

SEQ ID NO: 160 - DNA, 100 bp, Artificial Sequence
  Synthetic
atgtccatcttcgggcactgccctgcccatgatgacttctacttggttgtgtgtaaccactgcagccaagtggtgaagcctcaagctttccagaagcact

SEQ ID NO: 161 - DNA, 50 bp, Artificial Sequence
  Synthetic
acaaccaagtagaagtcatcatgggcagggcagtgcccgaagatggacat

SEQ ID NO: 162 - DNA, 40 bp, Artificial Sequence
  Synthetic
gaaagcttgaggcttcaccacttggctgcagtggttacac

SEQ ID NO: 163 - DNA, 100 bp, Artificial Sequence
  Synthetic
ggtggtcttgaactggctttagcctgtgatatacgagtagcagcttcctctgcaaaaatgggcctggttgaaacaaaattggcgattattcctggtggag

SEQ ID NO: 164 - DNA, 50 bp, Artificial Sequence
  Synthetic
gaggaagctgctactcgtatatcacaggctaaagccagttcaagaccacc

SEQ ID NO: 165 - DNA, 50 bp, Artificial Sequence
  Synthetic
ctccaccaggaataatcgccaattttgtttcaaccaggcccatttttgca

SEQ ID NO: 166 - DNA, 100 bp, Artificial Sequence
  Synthetic
aggcgccctgtaggatactgcttgttacttattacagctagagggtctcactccattgcccaggccagagtgcggggatatttgataagaaacttcagtg

SEQ ID NO: 167 - DNA, 48 bp, Artificial Sequence
  Synthetic
tgagaccctctagctgtaataagtaacaagcagtatcctacagggcgc

SEQ ID NO: 168 - DNA, 50 bp, Artificial Sequence
  Synthetic
cactgaagtttcttatcaaatatccccgcactctggcctgggcaatggag

SEQ ID NO: 169 - DNA, 100 bp, Artificial Sequence
  Synthetic
cttgtcctttcattcaaagaagagcagactcagccacccacaccactacagctcagatcgagaaaatgaccgcaatctctgccagcaccttgggaagaga

SEQ ID NO: 170 - DNA, 50 bp, Artificial Sequence
  Synthetic
tgtagtggtgtgggtggctgagtctgctcttctttgaatgaaaggacaag

SEQ ID NO: 171 - DNA, 50 bp, Artificial Sequence
  Synthetic
tctcttcccaaggtgctggcagagattgcggtcattttctcgatctgagc

SEQ ID NO: 172 - DNA, 100 bp, Artificial Sequence
  Synthetic
ggcaaatgaaatggaaggggaaggaaaacagaatggatcaggcatggagaccaaacacagcccactagaggttggcagtgagagttctgaagaccagtat

SEQ ID NO: 173 - DNA, 50 bp, Artificial Sequence
  Synthetic
tctccatgcctgatccattctgttttccttccccttccatttcatttgcc

SEQ ID NO: 174 - DNA, 43 bp, Artificial Sequence
  Synthetic
tcttcagaactctcactgccaacctctagtgggctgtgtttgg

SEQ ID NO: 175 - DNA, 100 bp, Artificial Sequence
  Synthetic
gatccgcgtctgaaagtgcagtacatcgtttgtacctgaaactgccgccacatgcactcctccaccgctgagagttgaatagcttttcttctgcaatggg

SEQ ID NO: 176 - DNA, 50 bp, Artificial Sequence
  Synthetic
tggcggcagtttcaggtacaaacgatgtactgcactttcagacgcggatc

SEQ ID NO: 177 - DNA, 50 bp, Artificial Sequence
  Synthetic
cccattgcagaagaaaagctattcaactctcagcggtggaggagtgcatg

SEQ ID NO: 178 - DNA, 100 bp, Artificial Sequence
  Synthetic
cactgtgggttgcaggcccaatgcagaagagtattaagaaagatgctcaagtcccatggcacagagcaaggcgggcagggaacggttatttttctaaata

SEQ ID NO: 179 - DNA, 45 bp, Artificial Sequence
  Synthetic
ttgagcatctttcttaatactcttctgcattgggcctgcaaccca

SEQ ID NO: 180 - DNA, 50 bp, Artificial Sequence
  Synthetic
tatttagaaaaataaccgttccctgcccgccttgctctgtgccatgggac

SEQ ID NO: 181 - DNA, 100 bp, Artificial Sequence
  Synthetic
ctgctgttatgcagagccatttcctctagaatttggataataaagatgcttattgtctctcccttctccagttctgggaatttacaggcacaatacactt

SEQ ID NO: 182 - DNA, 50 bp, Artificial Sequence
  Synthetic
agcatctttattatccaaattctagaggaaatggctctgcataacagcag

SEQ ID NO: 183 - DNA, 50 bp, Artificial Sequence
  Synthetic
aagtgtattgtgcctgtaaattcccagaactggagaagggagagacaata

SEQ ID NO: 184 - DNA, 100 bp, Artificial Sequence
  Synthetic
ccgacggaacaatgaaggattgcagtaacggatgctccgcagagtgtaccggagaaggaggatcaaaagaggtggtggggacttttaaggctaaagacct

SEQ ID NO: 185 - DNA, 49 bp, Artificial Sequence
  Synthetic
ggtacactctgcggagcatccgttactgcaatccttcattgttccgtcg

SEQ ID NO: 186 - DNA, 50 bp, Artificial Sequence
  Synthetic
aggtctttagccttaaaagtccccaccacctcttttgatcctccttctcc

SEQ ID NO: 187 - DNA, 100 bp, Artificial Sequence
  Synthetic
tgaaaataccatcttctcttcaactacacttcccagacctggggacccaggggctcctcctttgccaccagatctacagttagaagaagaaggaacttgt

SEQ ID NO: 188 - DNA, 50 bp, Artificial Sequence
  Synthetic
ctgggtccccaggtctgggaagtgtagttgaagagaagatggtattttca

SEQ ID NO: 189 - DNA, 50 bp, Artificial Sequence
  Synthetic
acaagttccttcttcttctaactgtagatctggtggcaaaggaggagccc

SEQ ID NO: 190 - DNA, 100 bp, Artificial Sequence
  Synthetic
tcatgtgtcataactcagtcaagctcagtgagcattctcagcacattgcctcaacagcttcaaggtgagccagctcaagactttgctctccaccaggcag

SEQ ID NO: 191 - DNA, 50 bp, Artificial Sequence
  Synthetic
ggcaatgtgctgagaatgctcactgagcttgactgagttatgacacatga

SEQ ID NO: 192 - DNA, 46 bp, Artificial Sequence
  Synthetic
ctggtggagagcaaagtcttgagctggctcaccttgaagctgttga

SEQ ID NO: 193 - DNA, 100 bp, Artificial Sequence
  Synthetic
ttttatctgaatgcatacaaggagtcctgaggtggtgatttggccagtgttttaacttgtgacaagtactcaggtgtgaggacaagaatgcaaatggctc

SEQ ID NO: 194 - DNA, 50 bp, Artificial Sequence
  Synthetic
acactggccaaatcaccacctcaggactccttgtatgcattcagataaaa

SEQ ID NO: 195 - DNA, 50 bp, Artificial Sequence
  Synthetic
gagccatttgcattcttgtcctcacacctgagtacttgtcacaagttaaa

SEQ ID NO: 196 - DNA, 100 bp, Artificial Sequence
  Synthetic
gttgtggacacttgccggaagtttattaaggccagtgaagcagagatggtttctgccatcaagcctcctcgtgaagagttcctcaacagccggatgctga

SEQ ID NO: 197 - DNA, 50 bp, Artificial Sequence
  Synthetic
accatctctgcttcactggccttaataaacttccggcaagtgtccacaac

SEQ ID NO: 198 - DNA, 50 bp, Artificial Sequence
  Synthetic
tcagcatccggctgttgaggaactcttcacgaggaggcttgatggcagaa

SEQ ID NO: 199 - DNA, 100 bp, Artificial Sequence
  Synthetic
tcttgcaactaaagcccggaatgaaggtagaatcagagacagtgttgatctgcaatcattgatgactgaaatgaatcgataccgctcttggtgcagcctc

SEQ ID NO: 200 - DNA, 50 bp, Artificial Sequence
  Synthetic
gatcaacactgtctctgattctaccttcattccgggctttagttgcaaga

SEQ ID NO: 201 - DNA, 50 bp, Artificial Sequence
  Synthetic
gaggctgcaccaagagcggtatcgattcatttcagtcatcaatgattgca

SEQ ID NO: 202 - DNA, 100 bp, Artificial Sequence
  Synthetic
tgggatccacctctaagaatacgtctccaatgagaaacagttttgcacattcattatctcccaccttggaacatagtagcttgttcagtggttcttactc

SEQ ID NO: 203 - DNA, 50 bp, Artificial Sequence
  Synthetic
atgtgcaaaactgtttctcattggagacgtattcttagaggtggatccca

SEQ ID NO: 204 - DNA, 50 bp, Artificial Sequence
  Synthetic
gagtaagaaccactgaacaagctactatgttccaaggtgggagataatga

SEQ ID NO: 205 - DNA, 100 bp, Artificial Sequence
  Synthetic
gtgatgtttctcctgccacctggaaacaaagcattgaagtctgcagttgaaaagcccaacgtctgtgagatccaggaaaccatgcttgcaaaccactggt

SEQ ID NO: 206 - DNA, 50 bp, Artificial Sequence
  Synthetic
tcaactgcagacttcaatgctttgtttccaggtggcaggagaaacatcac

SEQ ID NO: 207 - DNA, 50 bp, Artificial Sequence
  Synthetic
accagtggtttgcaagcatggtttcctggatctcacagacgttgggcttt

SEQ ID NO: 208 - DNA, 100 bp, Artificial Sequence
  Synthetic
ccattctaagtcattggggaaacggggtgaacttcaggtggatgaggagacagaatagagtgataggaagcgtctggcagatactccttttgccactgct

SEQ ID NO: 209 - DNA, 50 bp, Artificial Sequence
  Synthetic
tctcctcatccacctgaagttcaccccgtttccccaatgacttagaatgg

SEQ ID NO: 210 - DNA, 50 bp, Artificial Sequence
  Synthetic
agcagtggcaaaaggagtatctgccagacgcttcctatcactctattctg

SEQ ID NO: 211 - DNA, 100 bp, Artificial Sequence
  Synthetic
gcttcgtcaacctcgtggaacatgacaaggaattcttccacccacgctaccaccatcgagagttccggtttgatctttccaagatcccagaaggggaagc

SEQ ID NO: 212 - DNA, 50 bp, Artificial Sequence
  Synthetic
gtagcgtgggtggaagaattccttgtcatgttccacgaggttgacgaagc

SEQ ID NO: 213 - DNA, 50 bp, Artificial Sequence
  Synthetic
gcttccccttctgggatcttggaaagatcaaaccggaactctcgatggtg

SEQ ID NO: 214 - DNA, 100 bp, Artificial Sequence
  Synthetic
tttccagagctaggctgtggagtagagtttgtataggtaactaggtaacttattgtggcccagataaggctttaggatgcctcagtgcttatgtcatagc

SEQ ID NO: 215 - DNA, 50 bp, Artificial Sequence
  Synthetic
agttacctagttacctatacaaactctactccacagcctagctctggaaa

SEQ ID NO: 216 - DNA, 50 bp, Artificial Sequence
  Synthetic
gctatgacataagcactgaggcatcctaaagccttatctgggccacaata

SEQ ID NO: 217 - DNA, 100 bp, Artificial Sequence
  Synthetic
acactgtgttgatgcggttggtagcctccgcatattctattgctcaaaaggcaggaatgatagtcagacgtgttattgctgaaggagacctgggtattgt

SEQ ID NO: 218 - DNA, 50 bp, Artificial Sequence
  Synthetic
cttttgagcaatagaatatgcggaggctaccaaccgcatcaacacagtgt

SEQ ID NO: 219 - DNA, 50 bp, Artificial Sequence
  Synthetic
acaatacccaggtctccttcagcaataacacgtctgactatcattcctgc

SEQ ID NO: 220 - DNA, 100 bp, Artificial Sequence
  Synthetic
cactggcctggtgggcatgcttactcacctggatgacctccagctgattcagaaggagcaagagattttcgagaggaccgaagaagcagagggcattttg

SEQ ID NO: 221 - DNA, 40 bp, Artificial Sequence
  Synthetic
gaatcagctggaggtcatccaggtgagtaagcatgcccac

SEQ ID NO: 222 - DNA, 50 bp, Artificial Sequence
  Synthetic
caaaatgccctctgcttcttcggtcctctcgaaaatctcttgctccttct

SEQ ID NO: 223 - DNA, 100 bp, Artificial Sequence
  Synthetic
ttcgtatgactattgcagagtgcccatggaagacggggataagcgctgtaagcttctgctggggataggaattctggtgctcctgatcatcgtgattctg

SEQ ID NO: 224 - DNA, 35 bp, Artificial Sequence
  Synthetic
tacagcgcttatccccgtcttccatgggcactctg

SEQ ID NO: 225 - DNA, 50 bp, Artificial Sequence
  Synthetic
cagaatcacgatgatcaggagcaccagaattcctatccccagcagaagct

SEQ ID NO: 226 - DNA, 100 bp, Artificial Sequence
  Synthetic
tttttccgcagcactccgaagccttgtcaacaacccgcgatacagtgatgtttgcttcgtggttggtcaagaacggcaggaggtatttgcccatcggtgc

SEQ ID NO: 227 - DNA, 50 bp, Artificial Sequence
  Synthetic
catcactgtatcgcgggttgttgacaaggcttcggagtgctgcggaaaaa

SEQ ID NO: 228 - DNA, 50 bp, Artificial Sequence
  Synthetic
gcaccgatgggcaaatacctcctgccgttcttgaccaaccacgaagcaaa

SEQ ID NO: 229 - DNA, 100 bp, Artificial Sequence
  Synthetic
caacgtgcaaatggtagacagccgaatcagctgtaaggaggaacttctcttgggcagaacgagcccttccaaaaactacaatatgatgactgtatcaggt

SEQ ID NO: 230 - DNA, 50 bp, Artificial Sequence
  Synthetic
agagaagttcctccttacagctgattcggctgtctaccatttgcacgttg

SEQ ID NO: 231 - DNA, 50 bp, Artificial Sequence
  Synthetic
acctgatacagtcatcatattgtagtttttggaagggctcgttctgccca

SEQ ID NO: 232 - DNA, 100 bp, Artificial Sequence
  Synthetic
tgctctccttgggatgatggctggctagtcagccttgcatgtattccttggctgaatgggagagtgccccatgttctgcaagactacttggtattcttgt

SEQ ID NO: 233 - DNA, 48 bp, Artificial Sequence
  Synthetic
caaggaatacatgcaaggctgactagccagccatcatcccaaggagag

SEQ ID NO: 234 - DNA, 50 bp, Artificial Sequence
  Synthetic
acaagaataccaagtagtcttgcagaacatggggcactctcccattcagc

SEQ ID NO: 235 - DNA, 100 bp, Artificial Sequence
  Synthetic
tgatctggttcagaaatatcacccttgcttctggatcgatgggcagtatctctgctgctctcagacagccaaaaatgctatgggctgccaaattttggag

SEQ ID NO: 236 - DNA, 50 bp, Artificial Sequence
  Synthetic
gatactgcccatcgatccagaagcaagggtgatatttctgaaccagatca

SEQ ID NO: 237 - DNA, 50 bp, Artificial Sequence
  Synthetic
ctccaaaatttggcagcccatagcatttttggctgtctgagagcagcaga

SEQ ID NO: 238 - DNA, 100 bp, Artificial Sequence
  Synthetic
cccggaaaatgtccttcagatgcttgaagcccacatgcagagctacaagggcaatgaccctcttggtgaatgggaaagatacatacagtgggtagaagag

SEQ ID NO: 239 - DNA, 50 bp, Artificial Sequence
  Synthetic
ccttgtagctctgcatgtgggcttcaagcatctgaaggacattttccggg

SEQ ID NO: 240 - DNA, 50 bp, Artificial Sequence
  Synthetic
ctcttctacccactgtatgtatctttcccattcaccaagagggtcattgc

SEQ ID NO: 241 - DNA, 100 bp, Artificial Sequence
  Synthetic
gagtcttctgtaccacaacgaagcacactagctgaactaaagagcaaagggaaaaagacagcaagagctccaatcatccgtgtaggaggtgctctcaagg

SEQ ID NO: 242 - DNA, 50 bp, Artificial Sequence
  Synthetic
cctttgctctttagttcagctagtgtgcttcgttgtggtacagaagactc

SEQ ID NO: 243 - DNA, 50 bp, Artificial Sequence
  Synthetic
ccttgagagcacctcctacacggatgattggagctcttgctgtctttttc

SEQ ID NO: 244 - DNA, 100 bp, Artificial Sequence
  Synthetic
ccagaaaataccacagcggctcacaatgatcttcctgaaaactccatcgtcaactatgactcccaggccctaaatatgttagccgatctagcattaagct

SEQ ID NO: 245 - DNA, 50 bp, Artificial Sequence
  Synthetic
acgatggagttttcaggaagatcattgtgagccgctgtggtattttctgg

SEQ ID NO: 246 - DNA, 50 bp, Artificial Sequence
  Synthetic
agcttaatgctagatcggctaacatatttagggcctgggagtcatagttg

SEQ ID NO: 247 - DNA, 100 bp, Artificial Sequence
  Synthetic
cctccccatatcctgagactgacagtgctttttttgagccttcccatctgacatctgctgctgatgaaggtgctgttcaagtcagtagaagaaccatttc

SEQ ID NO: 248 - DNA, 50 bp, Artificial Sequence
  Synthetic
cagatgggaaggctcaaaaaaagcactgtcagtctcaggatatggggagg

SEQ ID NO: 249 - DNA, 50 bp, Artificial Sequence
  Synthetic
gaaatggttcttctactgacttgaacagcaccttcatcagcagcagatgt

SEQ ID NO: 250 - DNA, 100 bp, Artificial Sequence
  Synthetic
attaatggctcggcttatactggagaggtttctacaggaacacgaggaaactccaccctccaagtctattataaatagtatgctacgggacccttctcag

SEQ ID NO: 251 - DNA, 50 bp, Artificial Sequence
  Synthetic
tttcctcgtgttcctgtagaaacctctccagtataagccgagccattaat

SEQ ID NO: 252 - DNA, 50 bp, Artificial Sequence
  Synthetic
ctgagaagggtcccgtagcatactatttataatagacttggagggtggag

SEQ ID NO: 253 - DNA, 100 bp, Artificial Sequence
  Synthetic
cggggcaggtaccgttctgcagttcctcacccgcctgcgccgccatgccagcctggatggggccagcccctatttcaaggtcaagaagtggaagctggag

SEQ ID NO: 254 - DNA, 39 bp, Artificial Sequence
  Synthetic
tggcatggcggcgcaggcgggtgaggaactgcagaacgg

SEQ ID NO: 255 - DNA, 38 bp, Artificial Sequence
  Synthetic
cttcttgaccttgaaataggggctggccccatccaggc

SEQ ID NO: 256 - DNA, 100 bp, Artificial Sequence
  Synthetic
ccaagctgcagttcaatactaccaactgtcgtagtgataccgtaatggagaaacggtcatttaaggtgcctctgggaaagggaagacgctgtgtcgtttt

SEQ ID NO: 257 - DNA, 50 bp, Artificial Sequence
  Synthetic
ctccattacggtatcactacgacagttggtagtattgaactgcagcttgg

SEQ ID NO: 258 - DNA, 50 bp, Artificial Sequence
  Synthetic
aaaacgacacagcgtcttccctttcccagaggcaccttaaatgaccgttt

SEQ ID NO: 259 - DNA, 100 bp, Artificial Sequence
  Synthetic
tccaggcttctcgttcctggatattggtgcttagcatcttggcagggtccggggacgtggactatttcgcacaccacaccacggggagggatttttttct

SEQ ID NO: 260 - DNA, 50 bp, Artificial Sequence
  Synthetic
ggaccctgccaagatgctaagcaccaatatccaggaacgagaagcctgga

SEQ ID NO: 261 - DNA, 50 bp, Artificial Sequence
  Synthetic
agaaaaaaatccctccccgtggtgtggtgtgcgaaatagtccacgtcccc

SEQ ID NO: 262 - DNA, 100 bp, Artificial Sequence
  Synthetic
ttgcctgtctttcccagacttgtccctccttttccagcgggactcttctcatccttcctcatttgcaaggtgaacacttccttctagggagcaccctccc

SEQ ID NO: 263 - DNA, 50 bp, Artificial Sequence
  Synthetic
gagaagagtcccgctggaaaaggagggacaagtctgggaaagacaggcaa

SEQ ID NO: 264 - DNA, 50 bp, Artificial Sequence
  Synthetic
gggagggtgctccctagaaggaagtgttcaccttgcaaatgaggaaggat

SEQ ID NO: 265 - DNA, 100 bp, Artificial Sequence
  Synthetic
gctcctgtgtgttcttctaagactctgcaggctgaggtccctttgtcagactgtgtccaaaaagcaagtaaacccacttcaagcacacaaatcatggtga

SEQ ID NO: 266 - DNA, 50 bp, Artificial Sequence
  Synthetic
tctgacaaagggacctcagcctgcagagtcttagaagaacacacaggagc

SEQ ID NO: 267 - DNA, 50 bp, Artificial Sequence
  Synthetic
tcaccatgatttgtgtgcttgaagtgggtttacttgctttttggacacag

SEQ ID NO: 268 - DNA, 100 bp, Artificial Sequence
  Synthetic
caacacagagcccaccaagggccttccagaccatccatccagaagcatgtgataagacctccttccatactggccatattttggaacactgacctagaca

SEQ ID NO: 269 - DNA, 38 bp, Artificial Sequence
  Synthetic
acatgcttctggatggatggtctggaaggcccttggtg

SEQ ID NO: 270 - DNA, 50 bp, Artificial Sequence
  Synthetic
tgtctaggtcagtgttccaaaatatggccagtatggaaggaggtcttatc

SEQ ID NO: 271 - DNA, 100 bp, Artificial Sequence
  Synthetic
tcccagcctgcaaccactggagctttcctatgaggcctgcatgtccctcagcatcaccaacaatggccactctgtccaggtagacttcaatgacagcgat

SEQ ID NO: 272 - DNA, 40 bp, Artificial Sequence
  Synthetic
tgagggacatgcaggcctcataggaaagctccagtggttg

SEQ ID NO: 273 - DNA, 42 bp, Artificial Sequence
  Synthetic
cattgaagtctacctggacagagtggccattgttggtgatgc

SEQ ID NO: 274 - DNA, 100 bp, Artificial Sequence
  Synthetic
tatcgtgtgatttgcaagatgacgagcctgaggaaacaaaacgagaagaagaagatgatgtgttcaaaagaaatggtgccctgcttggaaaccatgtcaa

SEQ ID NO: 275 - DNA, 50 bp, Artificial Sequence
  Synthetic
ttcttctcgttttgtttcctcaggctcgtcatcttgcaaatcacacgata

SEQ ID NO: 276 - DNA, 50 bp, Artificial Sequence
  Synthetic
ttgacatggtttccaagcagggcaccatttcttttgaacacatcatcttc

SEQ ID NO: 277 - DNA, 100 bp, Artificial Sequence
  Synthetic
gattgacagcagactggagcagtataccagtgcaattgagggaacaaaaagcgcaaaacctacaaagccggcagcctcggatcttcctgttcctgctgaa

SEQ ID NO: 278 - DNA, 50 bp, Artificial Sequence
  Synthetic
tttttgttccctcaattgcactggtatactgctccagtctgctgtcaatc

SEQ ID NO: 279 - DNA, 50 bp, Artificial Sequence
  Synthetic
ttcagcaggaacaggaagatccgaggctgccggctttgtaggttttgcgc

SEQ ID NO: 280 - DNA, 100 bp, Artificial Sequence
  Synthetic
tcaccagaagctggagagagaggctcggatctgccgccttctgaagcattccaacatcgtgcgtctccacgacagcatctccgaggagggcttccactac

SEQ ID NO: 281 - DNA, 36 bp, Artificial Sequence
  Synthetic
aatgcttcagaaggcggcagatccgagcctctctct

SEQ ID NO: 282 - DNA, 38 bp, Artificial Sequence
  Synthetic
ctcctcggagatgctgtcgtggagacgcacgatgttgg

SEQ ID NO: 283 - DNA, 100 bp, Artificial Sequence
  Synthetic
gagccagaaatcagcgaggagctcaaggacctgatcctgaagatgttagacaagaatcccgagacgagaattggggtgccagacatcaagttgcaccctt

SEQ ID NO: 284 - DNA, 47 bp, Artificial Sequence
  Synthetic
tctaacatcttcaggatcaggtccttgagctcctcgctgatttctgg

SEQ ID NO: 285 - DNA, 50 bp, Artificial Sequence
  Synthetic
aagggtgcaacttgatgtctggcaccccaattctcgtctcgggattcttg

SEQ ID NO: 286 - DNA, 100 bp, Artificial Sequence
  Synthetic
ttgaaaatcggcccaagaaggagcaggttctggaactggagcgggagaatgaaatgctgaagaccaaaaaccaggagctgcagtccatcatccaggccgg

SEQ ID NO: 287 - DNA, 50 bp, Artificial Sequence
  Synthetic
attctcccgctccagttccagaacctgctccttcttgggccgattttcaa

SEQ ID NO: 288 - DNA, 50 bp, Artificial Sequence
  Synthetic
ccggcctggatgatggactgcagctcctggtttttggtcttcagcatttc

SEQ ID NO: 289 - DNA, 100 bp, Artificial Sequence
  Synthetic
aaccgcgaccctaaacacctcaacgatgacgtggtcaagattgactttgaagatgtgattgcagaaccagaagggacacacagttttgacggcatttgga

SEQ ID NO: 290 - DNA, 50 bp, Artificial Sequence
  Synthetic
tcaaagtcaatcttgaccacgtcatcgttgaggtgtttagggtcgcggtt

SEQ ID NO: 291 - DNA, 50 bp, Artificial Sequence
  Synthetic
tccaaatgccgtcaaaactgtgtgtcccttctggttctgcaatcacatct

SEQ ID NO: 292 - DNA, 100 bp, Artificial Sequence
  Synthetic
gccttttgtaaagacctgcctaatggttctgccttcagtgcagacaatatggaagagtgtgacagatgttatcattgctccattgtgtacgagcgtagga

SEQ ID NO: 293 - DNA, 50 bp, Artificial Sequence
  Synthetic
atattgtctgcactgaaggcagaaccattaggcaggtctttacaaaaggc

SEQ ID NO: 294 - DNA, 50 bp, Artificial Sequence
  Synthetic
tcctacgctcgtacacaatggagcaatgataacatctgtcacactcttcc

SEQ ID NO: 295 - DNA, 100 bp, Artificial Sequence
  Synthetic
aaacactttccagagttccctgcaacccgtgcttatgcagatagttactattatgaagatggaggaatgaagccaagagtgatgaaagaagctgtatcta

SEQ ID NO: 296 - DNA, 50 bp, Artificial Sequence
  Synthetic
tagtaactatctgcataagcacgggttgcagggaactctggaaagtgttt

SEQ ID NO: 297 - DNA, 50 bp, Artificial Sequence
  Synthetic
tagatacagcttctttcatcactcttggcttcattcctccatcttcataa

SEQ ID NO: 298 - DNA, 100 bp, Artificial Sequence
  Synthetic
acttggcaagagtgggggtggtattgttgaaccaattcctctcaatatcaaaacagggaaaagtggcattggtcatgaggcatcattaaaacggaaagca

SEQ ID NO: 299 - DNA, 50 bp, Artificial Sequence
  Synthetic
tgatattgagaggaattggttcaacaataccacccccactcttgccaagt

SEQ ID NO: 300 - DNA, 48 bp, Artificial Sequence
  Synthetic
ctttccgttttaatgatgcctcatgaccaatgccacttttccctgttt

SEQ ID NO: 301 - DNA, 100 bp, Artificial Sequence
  Synthetic
gcctggagtacttcaagggagccattccccttagaaagctgaagacgtggtaccagacatctgaggactgctccagggatgccatcgtttttgtaactgt

SEQ ID NO: 302 - DNA, 45 bp, Artificial Sequence
  Synthetic
ccacgtcttcagctttctaaggggaatggctcccttgaagtactc

SEQ ID NO: 303 - DNA, 50 bp, Artificial Sequence
  Synthetic
acagttacaaaaacgatggcatccctggagcagtcctcagatgtctggta

SEQ ID NO: 304 - DNA, 100 bp, Artificial Sequence
  Synthetic
cgggacaaagctggcctgaatcattaatacgaaagactggatataccctggaaagtcttaagccttgtctcatggaccttcaccagacctacctcaaagc

SEQ ID NO: 305 - DNA, 50 bp, Artificial Sequence
  Synthetic
cagggtatatccagtctttcgtattaatgattcaggccagctttgtcccg

SEQ ID NO: 306 - DNA, 50 bp, Artificial Sequence
  Synthetic
gctttgaggtaggtctggtgaaggtccatgagacaaggcttaagactttc

SEQ ID NO: 307 - DNA, 100 bp, Artificial Sequence
  Synthetic
aacttgaggaagagcaagcagtcagaccaaaatacctactgggtcgggaagtcactggaaacatgagagccatcctaattgactggctagtacaggttca

SEQ ID NO: 308 - DNA, 50 bp, Artificial Sequence
  Synthetic
ttcccgacccagtaggtattttggtctgactgcttgctcttcctcaagtt

SEQ ID NO: 309 - DNA, 50 bp, Artificial Sequence
  Synthetic
tgaacctgtactagccagtcaattaggatggctctcatgtttccagtgac

SEQ ID NO: 310 - DNA, 100 bp, Artificial Sequence
  Synthetic
aggttgatgttgaacagcacactttagccaagtatttgatggagctgactctcatcgactatgatatggtgcattatcatccttctaaggtagcagcagc

SEQ ID NO: 311 - DNA, 50 bp, Artificial Sequence
  Synthetic
agtcagctccatcaaatacttggctaaagtgtgctgttcaacatcaacct

SEQ ID NO: 312 - DNA, 50 bp, Artificial Sequence
  Synthetic
gctgctgctaccttagaaggatgataatgcaccatatcatagtcgatgag

SEQ ID NO: 313 - DNA, 100 bp, Artificial Sequence
  Synthetic
ttgaacacttcctctccaaaatgccagaggcggaggagaacaaacagatcatccgcaaacacgcgcagaccttcgttgccctctgtgccacagatgtgaa

SEQ ID NO: 314 - DNA, 50 bp, Artificial Sequence
  Synthetic
gatctgtttgttctcctccgcctctggcattttggagaggaagtgttcaa

SEQ ID NO: 315 - DNA, 50 bp, Artificial Sequence
  Synthetic
ttcacatctgtggcacagagggcaacgaaggtctgcgcgtgtttgcggat

SEQ ID NO: 316 - DNA, 100 bp, Artificial Sequence
  Synthetic
agcctgcatcccttcgcctgcagcctactttggggaaataaagtgccttactgactgtagccattacagtatccaatgtcttttgacaggtgcctgtcct

SEQ ID NO: 317 - DNA, 50 bp, Artificial Sequence
  Synthetic
taaggcactttatttccccaaagtaggctgcaggcgaagggatgcaggct

SEQ ID NO: 318 - DNA, 50 bp, Artificial Sequence
  Synthetic
aggacaggcacctgtcaaaagacattggatactgtaatggctacagtcag

SEQ ID NO: 319 - DNA, 100 bp, Artificial Sequence
  Synthetic
ggccagccatgtctgcatttcggtggctagtcaagctcctcctccctgcatctgaccagcagcgcctttcccaactctagctgggggtgggccaggctga

SEQ ID NO: 320 - DNA, 44 bp, Artificial Sequence
  Synthetic
tgcagggaggaggagcttgactagccaccgaaatgcagacatgg

SEQ ID NO: 321 - DNA, 35 bp, Artificial Sequence
  Synthetic
cccagctagagttgggaaaggcgctgctggtcaga

SEQ ID NO: 322 - DNA, 100 bp, Artificial Sequence
  Synthetic
ttccgaaaaccaggccttatctccaagaccagagatagtggggagacttcttggcttggtgaggaaaagcggacatcagctggtcaaacaaactctctga

SEQ ID NO: 323 - DNA, 50 bp, Artificial Sequence
  Synthetic
gaagtctccccactatctctggtcttggagataaggcctggttttcggaa

SEQ ID NO: 324 - DNA, 50 bp, Artificial Sequence
  Synthetic
tcagagagtttgtttgaccagctgatgtccgcttttcctcaccaagccaa

SEQ ID NO: 325 - DNA, 100 bp, Artificial Sequence
  Synthetic
tgggtctcactacaagcagcctatctgcttaagagactctggagtttcttatgtgccctggtggacacttgcccaccatcctgtgagtaaaagtgaaata

SEQ ID NO: 326 - DNA, 50 bp, Artificial Sequence
  Synthetic
aagaaactccagagtctcttaagcagataggctgcttgtagtgagaccca

SEQ ID NO: 327 - DNA, 50 bp, Artificial Sequence
  Synthetic
tatttcacttttactcacaggatggtgggcaagtgtccaccagggcacat

SEQ ID NO: 328 - DNA, 100 bp, Artificial Sequence
  Synthetic
ccctcggtcagggattgaaaatagtacagtgactctgtctcacccaaatgggaccacgtctgttaccagcatcctccatatcaaagaccctaagaatcag

SEQ ID NO: 329 - DNA, 50 bp, Artificial Sequence
  Synthetic
catttgggtgagacagagtcactgtactattttcaatccctgaccgaggg

SEQ ID NO: 330 - DNA, 50 bp, Artificial Sequence
  Synthetic
ctgattcttagggtctttgatatggaggatgctggtaacagacgtggtcc

SEQ ID NO: 331 - DNA, 100 bp, Artificial Sequence
  Synthetic
ttttccagaagatgaggggattcattactcagagctgatccagtttggggtcggggagcggcctcaggcacaagaaaatgtggactatgtgatcctcaaa

SEQ ID NO: 332 - DNA, 50 bp, Artificial Sequence
  Synthetic
ccccaaactggatcagctctgagtaatgaatcccctcatcttctggaaaa

SEQ ID NO: 333 - DNA, 50 bp, Artificial Sequence
  Synthetic
tttgaggatcacatagtccacattttcttgtgcctgaggccgctccccga

SEQ ID NO: 334 - DNA, 100 bp, Artificial Sequence
  Synthetic
tggcaggacaggaaaaacccgtcaatgtactaggatactgctgcgtcattacagggcacaggccatggatggaaaacgctctctgctctgctttttttct

SEQ ID NO: 335 - DNA, 50 bp, Artificial Sequence
  Synthetic
aatgacgcagcagtatcctagtacattgacgggtttttcctgtcctgcca

SEQ ID NO: 336 - DNA, 50 bp, Artificial Sequence
  Synthetic
agaaaaaaagcagagcagagagcgttttccatccatggcctgtgccctgt

SEQ ID NO: 337 - DNA, 100 bp, Artificial Sequence
  Synthetic
taggagattagatcctgaggaaaaccatacagctgaattggtcatcccagaactacctctggcacatcctccaaatgaaaggactcacttggtaattctg

SEQ ID NO: 338 - DNA, 50 bp, Artificial Sequence
  Synthetic
ctgggatgaccaattcagctgtatggttttcctcaggatctaatctccta

SEQ ID NO: 339 - DNA, 50 bp, Artificial Sequence
  Synthetic
cagaattaccaagtgagtcctttcatttggaggatgtgccagaggtagtt

SEQ ID NO: 340 - DNA, 100 bp, Artificial Sequence
  Synthetic
tatctactggatgagttccgctgggagatggaacatagcacgtttctctctggcctggtactggctacccttctctcgcaagtgagccccttcaagatac

SEQ ID NO: 341 - DNA, 50 bp, Artificial Sequence
  Synthetic
gagagaaacgtgctatgttccatctcccagcggaactcatccagtagata

SEQ ID NO: 342 - DNA, 35 bp, Artificial Sequence
  Synthetic
tcacttgcgagagaagggtagccagtaccaggcca

SEQ ID NO: 343 - DNA, 100 bp, Artificial Sequence
  Synthetic
aagtaacagtcccatgaaacaaagatgcagtcgggcactcactggagagttctgggcctctgcctcttatcagttggcgtttgggggcaagatggtaatg

SEQ ID NO: 344 - DNA, 50 bp, Artificial Sequence
  Synthetic
actctccagtgagtgcccgactgcatctttgtttcatgggactgttactt

SEQ ID NO: 345 - DNA, 50 bp, Artificial Sequence
  Synthetic
cattaccatcttgcccccaaacgccaactgataagaggcagaggcccaga

SEQ ID NO: 346 - DNA, 100 bp, Artificial Sequence
  Synthetic
agagcttcagacaagcagactctgttgcccaatgaccagctctaccagcccctcaaggatcgagaagatgaccagtacagccaccttcaaggaaaccagt

SEQ ID NO: 347 - DNA, 35 bp, Artificial Sequence
  Synthetic
ggctggtagagctggtcattgggcaacagagtctg

SEQ ID NO: 348 - DNA, 50 bp, Artificial Sequence
  Synthetic
actggtttccttgaaggtggctgtactggtcatcttctcgatccttgagg

SEQ ID NO: 349 - DNA, 100 bp, Artificial Sequence
  Synthetic
cccaggaagccatatacacagatgcccattgcagcattgtttgtgatagtgaacaactggaagctgcttaactgtccatcagcaggagactggctaaata

SEQ ID NO: 350 - DNA, 50 bp, Artificial Sequence
  Synthetic
actatcacaaacaatgctgcaatgggcatctgtgtatatggcttcctggg

SEQ ID NO: 351 - DNA, 50 bp, Artificial Sequence
  Synthetic
tatttagccagtctcctgctgatggacagttaagcagcttccagttgttc

SEQ ID NO: 352 - DNA, 100 bp, Artificial Sequence
  Synthetic
gtgggcagaagaaaaagctagtgatcaacagtggcaatggagctgtggaggacagaaagccaagtggactcaacggagaggccagcaagtctcaggaaat

SEQ ID NO: 353 - DNA, 50 bp, Artificial Sequence
  Synthetic
ctccacagctccattgccactgttgatcactagctttttcttctgcccac

SEQ ID NO: 354 - DNA, 35 bp, Artificial Sequence
  Synthetic
ctggcctctccgttgagtccacttggctttctgtc

SEQ ID NO: 355 - DNA, 100 bp, Artificial Sequence
  Synthetic
gccatattggttattcaggtgatagcctatatcctcgctgtggttggactgagtctctgtattgcggcgtgtataccaatgcatggccctcttctgattt

SEQ ID NO: 356 - DNA, 50 bp, Artificial Sequence
  Synthetic
agtccaaccacagcgaggatataggctatcacctgaataaccaatatggc

SEQ ID NO: 357 - DNA, 50 bp, Artificial Sequence
  Synthetic
aaatcagaagagggccatgcattggtatacacgccgcaatacagagactc

SEQ ID NO: 358 - DNA, 100 bp, Artificial Sequence
  Synthetic
ccagaagaagcagcgccagtggattggcccaacgggaatgaaccaaaacatgtctttccatcgcaaccacacggcaaccgtccgatcccatgctgagaac

SEQ ID NO: 359 - DNA, 50 bp, Artificial Sequence
  Synthetic
tgttttggttcattcccgttgggccaatccactggcgctgcttcttctgg

SEQ ID NO: 360 - DNA, 50 bp, Artificial Sequence
  Synthetic
gttctcagcatgggatcggacggttgccgtgtggttgcgatggaaagaca

SEQ ID NO: 361 - DNA, 100 bp, Artificial Sequence
  Synthetic
gtgcttgagtctcttccatctcccacactaacttgtgcattgactaatggaagcattgaagtccaatgcatgataccagagcattacaacagccatcgag

SEQ ID NO: 362 - DNA, 50 bp, Artificial Sequence
  Synthetic
ccattagtcaatgcacaagttagtgtgggagatggaagagactcaagcac

SEQ ID NO: 363 - DNA, 50 bp, Artificial Sequence
  Synthetic
ctcgatggctgttgtaatgctctggtatcatgcattggacttcaatgctt

SEQ ID NO: 364 - DNA, 100 bp, Artificial Sequence
  Synthetic
cgctggcagccagggtcctctgctcagcttcccggagtttgcacaatctgtccactcccgaagtccctgcaagtgttcagacagtcactatagaatcttc

SEQ ID NO: 365 - DNA, 45 bp, Artificial Sequence
  Synthetic
cagattgtgcaaactccgggaagctgagcagaggaccctggctgc

SEQ ID NO: 366 - DNA, 50 bp, Artificial Sequence
  Synthetic
gaagattctatagtgactgtctgaacacttgcagggacttcgggagtgga

SEQ ID NO: 367 - DNA, 100 bp, Artificial Sequence
  Synthetic
ttcagcccccagcccctcccccatctcccaccctgtacctcatcccatgagaccctggtgcctggctctttcgtcacccttggacaagacaaaccaagtc

SEQ ID NO: 368 - DNA, 35 bp, Artificial Sequence
  Synthetic
tcatgggatgaggtacagggtgggagatgggggag

SEQ ID NO: 369 - DNA, 47 bp, Artificial Sequence
  Synthetic
ttggtttgtcttgtccaagggtgacgaaagagccaggcaccagggtc

SEQ ID NO: 370 - DNA, 100 bp, Artificial Sequence
  Synthetic
aacgagaagctcgggttggatgccggggatgaatatgaagatgaaaacctttatgaaggcctgaacctggacgactgctccatgtatgaggacatctccc

SEQ ID NO: 371 - DNA, 50 bp, Artificial Sequence
  Synthetic
aggttttcatcttcatattcatccccggcatccaacccgagcttctcgtt

SEQ ID NO: 372 - DNA, 40 bp, Artificial Sequence
  Synthetic
ctcatacatggagcagtcgtccaggttcaggccttcataa

SEQ ID NO: 373 - DNA, 100 bp, Artificial Sequence
  Synthetic
taccggaatcccaaaggtagtgcttgttcgcggatctggcagagcccacgtttcatagccaggaaacggggcttcacggtgaaaatgcactgctacatga

SEQ ID NO: 374 - DNA, 47 bp, Artificial Sequence
  Synthetic
cgtgggctctgccagatccgcgaacaagcactacctttgggattccg

SEQ ID NO: 375 - DNA, 50 bp, Artificial Sequence
  Synthetic
tcatgtagcagtgcattttcaccgtgaagccccgtttcctggctatgaaa

SEQ ID NO: 376 - DNA, 100 bp, Artificial Sequence
  Synthetic
gctcagggctctttcctccacaccattcaggtctttctttccgaggcccctgtctcagggtgaggtgcttgagtctccaacggcaagggaacaagtactt

SEQ ID NO: 377 - DNA, 50 bp, Artificial Sequence
  Synthetic
ggggcctcggaaagaaagacctgaatggtgtggaggaaagagccctgagc

SEQ ID NO: 378 - DNA, 50 bp, Artificial Sequence
  Synthetic
aagtacttgttcccttgccgttggagactcaagcacctcaccctgagaca

SEQ ID NO: 379 - DNA, 100 bp, Artificial Sequence
  Synthetic
cagctgagtgtggttgatttccttcccaccactgcccagcccaccaagaagtccaccctcaagaagagagtgtgccggttacccaggccagagacccaga

SEQ ID NO: 380 - DNA, 47 bp, Artificial Sequence
  Synthetic
ttcttggtgggctgggcagtggtgggaaggaaatcaaccacactcag

SEQ ID NO: 381 - DNA, 37 bp, Artificial Sequence
  Synthetic
cctgggtaaccggcacactctcttcttgagggtggac

SEQ ID NO: 382 - DNA, 100 bp, Artificial Sequence
  Synthetic
ggaacatcagaaagcctgggctttgaacctgaacggttttgatgtagaggaagccaagatccttcggctcagtggaaaaccacaaaatgcgccagagggt

SEQ ID NO: 383 - DNA, 50 bp, Artificial Sequence
  Synthetic
cctctacatcaaaaccgttcaggttcaaagcccaggctttctgatgttcc

SEQ ID NO: 384 - DNA, 50 bp, Artificial Sequence
  Synthetic
accctctggcgcattttgtggttttccactgagccgaaggatcttggctt

SEQ ID NO: 385 - DNA, 100 bp, Artificial Sequence
  Synthetic
caccatacgagcacctccagcctgaacagaagctcttactctttcctatttcagtgttacctgtgtgcttggtctgtttgactttacgcccatctcagga

SEQ ID NO: 386 - DNA, 50 bp, Artificial Sequence
  Synthetic
aataggaaagagtaagagcttctgttcaggctggaggtgctcgtatggtg

SEQ ID NO: 387 - DNA, 50 bp, Artificial Sequence
  Synthetic
tcctgagatgggcgtaaagtcaaacagaccaagcacacaggtaacactga

SEQ ID NO: 388 - DNA, 100 bp, Artificial Sequence
  Synthetic
ctctctgtgtgacattactatcactcagatgctggaggaagattctaaccaggggcacctgattggtgatttttccaaggtatgtgcgctgccaaccgtg

SEQ ID NO: 389 - DNA, 50 bp, Artificial Sequence
  Synthetic
ggttagaatcttcctccagcatctgagtgatagtaatgtcacacagagag

SEQ ID NO: 390 - DNA, 50 bp, Artificial Sequence
  Synthetic
cacggttggcagcgcacataccttggaaaaatcaccaatcaggtgcccct

SEQ ID NO: 391 - DNA, 100 bp, Artificial Sequence
  Synthetic
aaggagccattcttggaactggacgacttctgaaaactggaggacgagcatgggagcaaggccaggaccatgacaaggaaaatcagcactttcccttggt

SEQ ID NO: 392 - DNA, 46 bp, Artificial Sequence
  Synthetic
tgctcgtcctccagttttcagaagtcgtccagttccaagaatggct

SEQ ID NO: 393 - DNA, 47 bp, Artificial Sequence
  Synthetic
aagggaaagtgctgattttccttgtcatggtcctggccttgctccca

SEQ ID NO: 394 - DNA, 100 bp, Artificial Sequence
  Synthetic
tgcagtcagaaagcccatcgtcttaaagaggatcgtggcccatgctgtagaggtcccagctgtccaatcacctcgcaggagccctaggatttcctttttc

SEQ ID NO: 395 - DNA, 46 bp, Artificial Sequence
  Synthetic
ctacagcatgggccacgatcctctttaagacgatgggctttctgac

SEQ ID NO: 396 - DNA, 50 bp, Artificial Sequence
  Synthetic
gaaaaaggaaatcctagggctcctgcgaggtgattggacagctgggacct

SEQ ID NO: 397 - DNA, 100 bp, Artificial Sequence
  Synthetic
tccctgtttactgaagaccaaatactggtttggagacaacttccatgtcttgctcttctacctccctagttagtggaaatttggataagggaactgtagg

SEQ ID NO: 398 - DNA, 50 bp, Artificial Sequence
  Synthetic
agacatggaagttgtctccaaaccagtatttggtcttcagtaaacaggga

SEQ ID NO: 399 - DNA, 50 bp, Artificial Sequence
  Synthetic
cctacagttcccttatccaaatttccactaactagggaggtagaagagca

SEQ ID NO: 400 - DNA, 100 bp, Artificial Sequence
  Synthetic
caggaagccaaagtcccagtggccattagggtccttgatgtcaacgataatgctcccaagtttgctgccccttatgaaggtttcatctgtgagagtgatc

SEQ ID NO: 401 - DNA, 50 bp, Artificial Sequence
  Synthetic
ttatcgttgacatcaaggaccctaatggccactgggactttggcttcctg

SEQ ID NO: 402 - DNA, 50 bp, Artificial Sequence
  Synthetic
gatcactctcacagatgaaaccttcataaggggcagcaaacttgggagca

SEQ ID NO: 403 - DNA, 100 bp, Artificial Sequence
  Synthetic
cacatgaggtagtaacactctggtacagatctccagaagtattgctggggtcagctcgttactcaactccagttgacatttggagtataggcaccatatt

SEQ ID NO: 404 - DNA, 50 bp, Artificial Sequence
  Synthetic
ccccagcaatacttctggagatctgtaccagagtgttactacctcatgtg

SEQ ID NO: 405 - DNA, 50 bp, Artificial Sequence
  Synthetic
aatatggtgcctatactccaaatgtcaactggagttgagtaacgagctga

SEQ ID NO: 406 - DNA, 100 bp, Artificial Sequence
  Synthetic
attactcagtggacggagaagtctgttttgttacagagacatgcctctcagaaggtcaggaggttttgagtacctatccttgccacccatacaggaaatc

SEQ ID NO: 407 - DNA, 50 bp, Artificial Sequence
  Synthetic
tgagaggcatgtctctgtaacaaaacagacttctccgtccactgagtaat

SEQ ID NO: 408 - DNA, 50 bp, Artificial Sequence
  Synthetic
gatttcctgtatgggtggcaaggataggtactcaaaacctcctgaccttc

SEQ ID NO: 409 - DNA, 100 bp, Artificial Sequence
  Synthetic
acttttaacccacacaagcgaatctctgcctttcgagctctgcagcactcttatctacataaggatgaaggtaatccggagtgagcaatggagtggctgc

SEQ ID NO: 410 - DNA, 50 bp, Artificial Sequence
  Synthetic
gagtgctgcagagctcgaaaggcagagattcgcttgtgtgggttaaaagt

SEQ ID NO: 411 - DNA, 50 bp, Artificial Sequence
  Synthetic
gcagccactccattgctcactccggattaccttcatccttatgtagataa

SEQ ID NO: 412 - DNA, 100 bp, Artificial Sequence
  Synthetic
agcaactggagcaggatgtgctttcatatcagaatttgcggaagaccttggaggagcagatcagcgaaattcggaggcgggaagaagaatcattttcact

SEQ ID NO: 413 - DNA, 50 bp, Artificial Sequence
  Synthetic
caaggtcttccgcaaattctgatatgaaagcacatcctgctccagttgct

SEQ ID NO: 414 - DNA, 50 bp, Artificial Sequence
  Synthetic
agtgaaaatgattcttcttcccgcctccgaatttcgctgatctgctcctc

SEQ ID NO: 415 - DNA, 100 bp, Artificial Sequence
  Synthetic
gggaaagaaaagtgcaatgattctggactgagacgcgcttgggcagaggctatgtaatcgtgtctgtgttgaggacttcgcttcgaggagggaagaggag

SEQ ID NO: 416 - DNA, 48 bp, Artificial Sequence
  Synthetic
gcctctgcccaagcgcgtctcagtccagaatcattgcacttttctttc

SEQ ID NO: 417 - DNA, 50 bp, Artificial Sequence
  Synthetic
ctcctcttccctcctcgaagcgaagtcctcaacacagacacgattacata

SEQ ID NO: 418 - DNA, 100 bp, Artificial Sequence
  Synthetic
taccgaaaaaccttaatacactgctatggaggacttgggagatcttgtcttgtagctgcttgtctcctactatacctgtctgacacaatatcaccagagc

SEQ ID NO: 419 - DNA, 50 bp, Artificial Sequence
  Synthetic
agacaagatctcccaagtcctccatagcagtgtattaaggtttttcggta

SEQ ID NO: 420 - DNA, 49 bp, Artificial Sequence
  Synthetic
ctctggtgatattgtgtcagacaggtatagtaggagacaagcagctaca

SEQ ID NO: 421 - DNA, 100 bp, Artificial Sequence
  Synthetic
cctgggaccttaaagcgttgcaggttcctgatttggacagaggtgtggggccttccaggccgttacatacctcctgccaattctctaactctctgagact

SEQ ID NO: 422 - DNA, 46 bp, Artificial Sequence
  Synthetic
ccccacacctctgtccaaatcaggaacctgcaacgctttaaggtcc

SEQ ID NO: 423 - DNA, 50 bp, Artificial Sequence
  Synthetic
agtctcagagagttagagaattggcaggaggtatgtaacggcctggaagg

SEQ ID NO: 424 - DNA, 100 bp, Artificial Sequence
  Synthetic
cactttgagcagttgcctggaaggctgggcatttccatcatatagacctctgcccttcagagtagcctcaccattagtggcagcatcatgtaactgagtg

SEQ ID NO: 425 - DNA, 50 bp, Artificial Sequence
  Synthetic
gaggtctatatgatggaaatgcccagccttccaggcaactgctcaaagtg

SEQ ID NO: 426 - DNA, 50 bp, Artificial Sequence
  Synthetic
cactcagttacatgatgctgccactaatggtgaggctactctgaagggca

SEQ ID NO: 427 - DNA, 100 bp, Artificial Sequence
  Synthetic
gcaccaatcatcgattctgccatacaaggctacaatggtactatatttgcctatggacagactgcttcaggaaaaacatataccatgatgggttcagaag

SEQ ID NO: 428 - DNA, 50 bp, Artificial Sequence
  Synthetic
gcaaatatagtaccattgtagccttgtatggcagaatcgatgattggtgc

SEQ ID NO: 429 - DNA, 50 bp, Artificial Sequence
  Synthetic
cttctgaacccatcatggtatatgtttttcctgaagcagtctgtccatag

SEQ ID NO: 430 - DNA, 100 bp, Artificial Sequence
  Synthetic
agataatgtggccaaggtgaatgacagctggaaggagagatttcttgatgtggaaaatgagctgagtaggatcagatcggagaaagctagcattgagcat

SEQ ID NO: 431 - DNA, 50 bp, Artificial Sequence
  Synthetic
catcaagaaatctctccttccagctgtcattcaccttggccacattatct

SEQ ID NO: 432 - DNA, 50 bp, Artificial Sequence
  Synthetic
atgctcaatgctagctttctccgatctgatcctactcagctcattttcca

SEQ ID NO: 433 - DNA, 100 bp, Artificial Sequence
  Synthetic
ctcccagactccgtacgccttcacgtcctcctccatgctgaggcgcaatacaccgcttctgggtcaggagttagaagctactgggaaaatctacctccga

SEQ ID NO: 434 - DNA, 42 bp, Artificial Sequence
  Synthetic
tattgcgcctcagcatggaggaggacgtgaaggcgtacggag

SEQ ID NO: 435 - DNA, 50 bp, Artificial Sequence
  Synthetic
tcggaggtagattttcccagtagcttctaactcctgacccagaagcggtg

SEQ ID NO: 436 - DNA, 100 bp, Artificial Sequence
  Synthetic
ttcattgttccagcttctcgcttcaagctcctgaagggagctgagcacataacgacttacacgttcaatactcacaaagcccagcataccttctgtaaga

SEQ ID NO: 437 - DNA, 50 bp, Artificial Sequence
  Synthetic
atgtgctcagctcccttcaggagcttgaagcgagaagctggaacaatgaa

SEQ ID NO: 438 - DNA, 50 bp, Artificial Sequence
  Synthetic
tcttacagaaggtatgctgggctttgtgagtattgaacgtgtaagtcgtt

SEQ ID NO: 439 - DNA, 100 bp, Artificial Sequence
  Synthetic
ctgcccgctctgataacagtccttttccctggcgctcacttcgtgcctggcacccggctgggcgcctcaagaccgttgtctcttcgatcgcttctttgga

SEQ ID NO: 440 - DNA, 47 bp, Artificial Sequence
  Synthetic
ccaggcacgaagtgagcgccagggaaaaggactgttatcagagcggg

SEQ ID NO: 441 - DNA, 50 bp, Artificial Sequence
  Synthetic
tccaaagaagcgatcgaagagacaacggtcttgaggcgcccagccgggtg

SEQ ID NO: 442 - DNA, 100 bp, Artificial Sequence
  Synthetic
caagacccttgtgagcttccctagtctaagagtaggatgtctgctgaagtcatccatcaggttgaagaagcacttgatacagatgagaaggagatgctgc

SEQ ID NO: 443 - DNA, 50 bp, Artificial Sequence
  Synthetic
acttcagcagacatcctactcttagactagggaagctcacaagggtcttg

SEQ ID NO: 444 - DNA, 50 bp, Artificial Sequence
  Synthetic
gcagcatctccttctcatctgtatcaagtgcttcttcaacctgatggatg

SEQ ID NO: 445 - DNA, 100 bp, Artificial Sequence
  Synthetic
tgaaccatggagctgtatttcggtgaatatcaacatgtgcagcaggaatatggggtccatctgagactcgcaagtgatgatacccaaaaatcaaggagtt

SEQ ID NO: 446 - DNA, 50 bp, Artificial Sequence
  Synthetic
tattcctgctgcacatgttgatattcaccgaaatacagctccatggttca

SEQ ID NO: 447 - DNA, 45 bp, Artificial Sequence
  Synthetic
cttgatttttgggtatcatcacttgcgagtctcagatggacccca

SEQ ID NO: 448 - DNA, 100 bp, Artificial Sequence
  Synthetic
agaggcatctgtgaaattccatgtgctgctgacatcctatgaattgatcaccattgacatggctattttgggctctattgattgggcctgcctcatcgtg

SEQ ID NO: 449 - DNA, 50 bp, Artificial Sequence
  Synthetic
tgatcaattcataggatgtcagcagcacatggaatttcacagatgcctct

SEQ ID NO: 450 - DNA, 50 bp, Artificial Sequence
  Synthetic
cacgatgaggcaggcccaatcaatagagcccaaaatagccatgtcaatgg

SEQ ID NO: 451 - DNA, 100 bp, Artificial Sequence
  Synthetic
taggaggctgaggtgggagaatcacttggactccaaaggtggaggttgcagtaagctgaaatcatgccactgcaccctagcttgggtggcaaagcaaaac

SEQ ID NO: 452 - DNA, 38 bp, Artificial Sequence
  Synthetic
tgcaacctccacctttggagtccaagtgattctcccac

SEQ ID NO: 453 - DNA, 38 bp, Artificial Sequence
  Synthetic
cacccaagctagggtgcagtggcatgatttcagcttac

SEQ ID NO: 454 - DNA, 100 bp, Artificial Sequence
  Synthetic
gcctgagcaaggacattttcaagcacataggaccagatgaagtgatcggtgagagtatggagatgccagcagaagttgggcagaaaagtcagaaaagacc

SEQ ID NO: 455 - DNA, 50 bp, Artificial Sequence
  Synthetic
accgatcacttcatctggtcctatgtgcttgaaaatgtccttgctcaggc

SEQ ID NO: 456 - DNA, 50 bp, Artificial Sequence
  Synthetic
ggtcttttctgacttttctgcccaacttctgctggcatctccatactctc

SEQ ID NO: 457 - DNA, 100 bp, Artificial Sequence
  Synthetic
aaactcatctgatgtctgaagaggagtggaggagacttggtgtccaacagagtctaggctgggttcattacatgattcatgagccagaaccacatattct

SEQ ID NO: 458 - DNA, 50 bp, Artificial Sequence
  Synthetic
ctgttggacaccaagtctcctccactcctcttcagacatcagatgagttt

SEQ ID NO: 459 - DNA, 50 bp, Artificial Sequence
  Synthetic
agaatatgtggttctggctcatgaatcatgtaatgaacccagcctagact

SEQ ID NO: 460 - DNA, 100 bp, Artificial Sequence
  Synthetic
gtccctgttggctttcggtagctctcgcatgcagttctattaacagccgtctagaagcgatgctttagtggcctaacccagggtcaaatacagctctttc

SEQ ID NO: 461 - DNA, 50 bp, Artificial Sequence
  Synthetic
acggctgttaatagaactgcatgcgagagctaccgaaagccaacagggac

SEQ ID NO: 462 - DNA, 50 bp, Artificial Sequence
  Synthetic
gaaagagctgtatttgaccctgggttaggccactaaagcatcgcttctag

SEQ ID NO: 463 - DNA, 100 bp, Artificial Sequence
  Synthetic
tactcaaaactcaggcatgcagctggatccgtaggtggggttttgtccttgtgtgccttgctgggttggatagggagcattgttagtgatcattagcccg

SEQ ID NO: 464 - DNA, 50 bp, Artificial Sequence
  Synthetic
aaggacaaaaccccacctacggatccagctgcatgcctgagttttgagta

SEQ ID NO: 465 - DNA, 50 bp, Artificial Sequence
  Synthetic
cgggctaatgatcactaacaatgctccctatccaacccagcaaggcacac

SEQ ID NO: 466 - DNA, 100 bp, Artificial Sequence
  Synthetic
gcagacgatcacgactcaaaagagctgtttggatagactgtggtattcatgcaagagaatggattggtcctgccttttgtcagtggtttgtaaaagaagc

SEQ ID NO: 467 - DNA, 50 bp, Artificial Sequence
  Synthetic
atgaataccacagtctatccaaacagctcttttgagtcgtgatcgtctgc

SEQ ID NO: 468 - DNA, 50 bp, Artificial Sequence
  Synthetic
gcttcttttacaaaccactgacaaaaggcaggaccaatccattctcttgc

SEQ ID NO: 469 - DNA, 100 bp, Artificial Sequence
  Synthetic
gactgctctctggtctgtgggactggtcattcaagattatgatgctgataagatgtttccagcttttggttttggcgctcagatacctcctcagtggcag

SEQ ID NO: 470 - DNA, 50 bp, Artificial Sequence
  Synthetic
tatcagcatcataatcttgaatgaccagtcccacagaccagagagcagtc

SEQ ID NO: 471 - DNA, 50 bp, Artificial Sequence
  Synthetic
ctgccactgaggaggtatctgagcgccaaaaccaaaagctggaaacatct

SEQ ID NO: 472 - DNA, 100 bp, Artificial Sequence
  Synthetic
ggtgtcaagcaaataatatgtgggggccgacacgactaccaacctgtgtaagtgttttccctctcgagtgtccagcacttcctatgatccacaatggaca

SEQ ID NO: 473 - DNA, 50 bp, Artificial Sequence
  Synthetic
tacacaggttggtagtcgtgtcggcccccacatattatttgcttgacacc

SEQ ID NO: 474 - DNA, 50 bp, Artificial Sequence
  Synthetic
tgtccattgtggatcataggaagtgctggacactcgagagggaaaacact

SEQ ID NO: 475 - DNA, 100 bp, Artificial Sequence
  Synthetic
atgcctgaggggatcaggcttttctactccaggcaaacctgccccatcttgtcgcttttaggacctcccacaacctggttccccacacatccatagttct

SEQ ID NO: 476 - DNA, 43 bp, Artificial Sequence
  Synthetic
aagatggggcaggtttgcctggagtagaaaagcctgatcccct

SEQ ID NO: 477 - DNA, 50 bp, Artificial Sequence
  Synthetic
agaactatggatgtgtggggaaccaggttgtgggaggtcctaaaagcgac

SEQ ID NO: 478 - DNA, 100 bp, Artificial Sequence
  Synthetic
cacattcgaggctcacaggtgattgtcgctcacacagttagggtcgtcagttggtctgaaactgcatttggcccactcctccatcctccctgtccgtcgt

SEQ ID NO: 479 - DNA, 50 bp, Artificial Sequence
  Synthetic
ctgacgaccctaactgtgtgagcgacaatcacctgtgagcctcgaatgtg

SEQ ID NO: 480 - DNA, 50 bp, Artificial Sequence
  Synthetic
acgacggacagggaggatggaggagtgggccaaatgcagtttcagaccaa

SEQ ID NO: 481 - DNA, 100 bp, Artificial Sequence
  Synthetic
agaaggagggagatccggtgtccttattacatacaagactcaggaacccatgtgggatgtcacctggataacctgtcaggattaacgtctcgcaattact

SEQ ID NO: 482 - DNA, 48 bp, Artificial Sequence
  Synthetic
tgggttcctgagtcttgtatgtaataaggacaccggatctccctcctt

SEQ ID NO: 483 - DNA, 50 bp, Artificial Sequence
  Synthetic
agtaattgcgagacgttaatcctgacaggttatccaggtgacatcccaca

SEQ ID NO: 484 - DNA, 100 bp, Artificial Sequence
  Synthetic
cttcccggacaaaatgaggacttggtacttactggataccaggttgacaaaaacaaggatgacgagctgacgggcttttagcagcatgtacccaaagtgt

SEQ ID NO: 485 - DNA, 50 bp, Artificial Sequence
  Synthetic
ttgtcaacctggtatccagtaagtaccaagtcctcattttgtccgggaag

SEQ ID NO: 486 - DNA, 50 bp, Artificial Sequence
  Synthetic
acactttgggtacatgctgctaaaagcccgtcagctcgtcatccttgttt

SEQ ID NO: 487 - DNA, 100 bp, Artificial Sequence
  Synthetic
accaccctgccggtggagttcaagtgccctgacggcgaggtcatgaagaagaacatgatgttcatcaagacctgtgcctgccattacaactgtcccggag

SEQ ID NO: 488 - DNA, 41 bp, Artificial Sequence
  Synthetic
ttcttcatgacctcgccgtcagggcacttgaactccaccgg

SEQ ID NO: 489 - DNA, 50 bp, Artificial Sequence
  Synthetic
ctccgggacagttgtaatggcaggcacaggtcttgatgaacatcatgttc

SEQ ID NO: 490 - DNA, 100 bp, Artificial Sequence
  Synthetic
ctcgccgtcggctctacctgcgtgctttagctccttctcgcctgatccttctgtctctcccaaccccggacacccggcttcgactggttatatcttcggt

SEQ ID NO: 491 - DNA, 50 bp, Artificial Sequence
  Synthetic
aaggatcaggcgagaaggagctaaagcacgcaggtagagccgacggcgag

SEQ ID NO: 492 - DNA, 50 bp, Artificial Sequence
  Synthetic
accgaagatataaccagtcgaagccgggtgtccggggttgggagagacag

SEQ ID NO: 493 - DNA, 100 bp, Artificial Sequence
  Synthetic
ctgtggaaggactttgtgaaggaattggtgctggattagtggatgttgctatctgggttggcacttgttcagattacccaaaaggagatgcttctactgg

SEQ ID NO: 494 - DNA, 50 bp, Artificial Sequence
  Synthetic
agcaacatccactaatccagcaccaattccttcacaaagtccttccacag

SEQ ID NO: 495 - DNA, 50 bp, Artificial Sequence
  Synthetic
ccagtagaagcatctccttttgggtaatctgaacaagtgccaacccagat

SEQ ID NO: 496 - DNA, 100 bp, Artificial Sequence
  Synthetic
agtctgtgcggcaacctacatgatggggaatgagttgaccttcctagatgattccatctgcacgggcacctccagtggaaatcaagtgaacctcactatc

SEQ ID NO: 497 - DNA, 43 bp, Artificial Sequence
  Synthetic
catctaggaaggtcaactcattccccatcatgtaggttgccgc

SEQ ID NO: 498 - DNA, 50 bp, Artificial Sequence
  Synthetic
gatagtgaggttcacttgatttccactggaggtgcccgtgcagatggaat

SEQ ID NO: 499 - DNA, 100 bp, Artificial Sequence
  Synthetic
gaaccatgattttgctagaaatagaaggcccagtggtggaatattagagggaaggaaactgacaacgtgtgaaagttagaggcaaatacataggtgtagc

SEQ ID NO: 500 - DNA, 50 bp, Artificial Sequence
  Synthetic
cctctaatattccaccactgggccttctatttctagcaaaatcatggttc

SEQ ID NO: 501 - DNA, 49 bp, Artificial Sequence
  Synthetic
ctacacctatgtatttgcctctaactttcacacgttgtcagtttccttc

SEQ ID NO: 502 - DNA, 100 bp, Artificial Sequence
  Synthetic
caccttgtttctcaactacctcgcatcattgcagatgctagcgcgttgcctgtcgctttcccttggatacctagaccgttataaagtgtgccacatggac

SEQ ID NO: 503 - DNA, 50 bp, Artificial Sequence
  Synthetic
ggcaacgcgctagcatctgcaatgatgcgaggtagttgagaaacaaggtg

SEQ ID NO: 504 - DNA, 50 bp, Artificial Sequence
  Synthetic
gtccatgtggcacactttataacggtctaggtatccaagggaaagcgaca

SEQ ID NO: 505 - DNA, 100 bp, Artificial Sequence
  Synthetic
accctgtgagctttgcctttgaggtgactcaggacttcatgatgtatagaacgggcatctactccagtacttcctgccataaaactccagataaagtaaa

SEQ ID NO: 506 - DNA, 50 bp, Artificial Sequence
  Synthetic
tctatacatcatgaagtcctgagtcacctcaaaggcaaagctcacagggt

SEQ ID NO: 507 - DNA, 50 bp, Artificial Sequence
  Synthetic
tttactttatctggagttttatggcaggaagtactggagtagatgcccgt

SEQ ID NO: 508 - DNA, 100 bp, Artificial Sequence
  Synthetic
tctcattcccgcagtaatgacaccctttatatcccagaatgggaaggtagagccccagactctgtcgactatcgaaagaaaggatatgttactcctgtca

SEQ ID NO: 509 - DNA, 50 bp, Artificial Sequence
  Synthetic
ctaccttcccattctgggatataaagggtgtcattactgcgggaatgaga

SEQ ID NO: 510 - DNA, 50 bp, Artificial Sequence
  Synthetic
tgacaggagtaacatatcctttctttcgatagtcgacagagtctggggct

SEQ ID NO: 511 - DNA, 100 bp, Artificial Sequence
  Synthetic
gcagaggaacctccagtctcagcaccatgaatcaaactgcgattctgatttgctgccttatctttctgactctaagtggcattcaaggagtacctctctc

SEQ ID NO: 512 - DNA, 50 bp, Artificial Sequence
  Synthetic
aatcagaatcgcagtttgattcatggtgctgagactggaggttcctctgc

SEQ ID NO: 513 - DNA, 50 bp, Artificial Sequence
  Synthetic
gagagaggtactccttgaatgccacttagagtcagaaagataaggcagca

SEQ ID NO: 514 - DNA, 100 bp, Artificial Sequence
  Synthetic
gggcctgaggtttgccagcatttagaccctgcatttatagcatacggtatgatattgcagcttatattcatccatgccctgtacctgtgcacgttggaac

SEQ ID NO: 515 - DNA, 50 bp, Artificial Sequence
  Synthetic
ataccgtatgctataaatgcagggtctaaatgctggcaaacctcaggccc

SEQ ID NO: 516 - DNA, 50 bp, Artificial Sequence
  Synthetic
gttccaacgtgcacaggtacagggcatggatgaatataagctgcaatatc

SEQ ID NO: 517 - DNA, 100 bp, Artificial Sequence
  Synthetic
caccatctcccatgaagaaagggaacggtgaagtactaagcgctagaggaagcagccaagtcggttagtggaagcatgattggtgcccagttagcctctg

SEQ ID NO: 518 - DNA, 50 bp, Artificial Sequence
  Synthetic
tcctctagcgcttagtacttcaccgttccctttcttcatgggagatggtg

SEQ ID NO: 519 - DNA, 45 bp, Artificial Sequence
  Synthetic
gctaactgggcaccaatcatgcttccactaaccgacttggctgct

SEQ ID NO: 520 - DNA, 100 bp, Artificial Sequence
  Synthetic
ccatgtcttagggcttcctgtaggtaactatgtccagctcttggcaaaaatcgataatgaattggtggtcagggcttacacccctgtctccagtgatgat

SEQ ID NO: 521 - DNA, 50 bp, Artificial Sequence
  Synthetic
tttttgccaagagctggacatagttacctacaggaagccctaagacatgg

SEQ ID NO: 522 - DNA, 50 bp, Artificial Sequence
  Synthetic
atcatcactggagacaggggtgtaagccctgaccaccaattcattatcga

SEQ ID NO: 523 - DNA, 100 bp, Artificial Sequence
  Synthetic
tttgctacatcctgttcgagaaacgcattggctgcctgcagcgatccatccccgaggacaccgtgaccttcgtcagatccatcgggttaatgttccagaa

SEQ ID NO: 524 - DNA, 50 bp, Artificial Sequence
  Synthetic
gatggatcgctgcaggcagccaatgcgtttctcgaacaggatgtagcaaa

SEQ ID NO: 525 - DNA, 50 bp, Artificial Sequence
  Synthetic
ttctggaacattaacccgatggatctgacgaaggtcacggtgtcctcggg

SEQ ID NO: 526 - DNA, 100 bp, Artificial Sequence
  Synthetic
gaaaaatggattgattatgtcaagtggccaggcatggaaggagcaaagaaggttcactctgacagcactaaggaactttggtttaggaaagaagagctta

SEQ ID NO: 527 - DNA, 45 bp, Artificial Sequence
  Synthetic
ttctttgctccttccatgcctggccacttgacataatcaatccat

SEQ ID NO: 528 - DNA, 50 bp, Artificial Sequence
  Synthetic
taagctcttctttcctaaaccaaagttccttagtgctgtcagagtgaacc

SEQ ID NO: 529 - DNA, 100 bp, Artificial Sequence
  Synthetic
aaagaagcttgcctatagagcaggcactctgtgaatggactgtgcttttacgaccctacagggtatcaagatactgtgcagctcgccaacaaggattaat

SEQ ID NO: 530 - DNA, 50 bp, Artificial Sequence
  Synthetic
taaaagcacagtccattcacagagtgcctgctctataggcaagcttcttt

SEQ ID NO: 531 - DNA, 50 bp, Artificial Sequence
  Synthetic
attaatccttgttggcgagctgcacagtatcttgataccctgtagggtcg

SEQ ID NO: 532 - DNA, 100 bp, Artificial Sequence
  Synthetic
atgccattacttctgctttcgtatctcctcaggcaaaagtggagggtgccttatgggccctcctcataggttgtctctgcatacacgaacctaacccaaa

SEQ ID NO: 533 - DNA, 50 bp, Artificial Sequence
  Synthetic
ggcaccctccacttttgcctgaggagatacgaaagcagaagtaatggcat

SEQ ID NO: 534 - DNA, 50 bp, Artificial Sequence
  Synthetic
tttgggttaggttcgtgtatgcagagacaacctatgaggagggcccataa

SEQ ID NO: 535 - DNA, 100 bp, Artificial Sequence
  Synthetic
ctcttgttgaacacaagtgaagtaaccgtccgctttgagagtggatcccacatttctggccggggttttttgctgacctatgcgagcagcgaccatccag

SEQ ID NO: 536 - DNA, 50 bp, Artificial Sequence
  Synthetic
tgggatccactctcaaagcggacggttacttcacttgtgttcaacaagag

SEQ ID NO: 537 - DNA, 50 bp, Artificial Sequence
  Synthetic
ctggatggtcgctgctcgcataggtcagcaaaaaaccccggccagaaatg

SEQ ID NO: 538 - DNA, 100 bp, Artificial Sequence
  Synthetic
gaaaaagccatgtatgtctggaggcagaaggatgactctcagagatgaccaacctgcaaagctagaaaaggagcccaagacgaggccagaagagaacaag

SEQ ID NO: 539 - DNA, 50 bp, Artificial Sequence
  Synthetic
ggtcatctctgagagtcatccttctgcctccagacatacatggctttttc

SEQ ID NO: 540 - DNA, 50 bp, Artificial Sequence
  Synthetic
cttgttctcttctggcctcgtcttgggctccttttctagctttgcaggtt

SEQ ID NO: 541 - DNA, 100 bp, Artificial Sequence
  Synthetic
gatccggcagcctctcttcactgctacatgtgctggaaggacaaataaataattgtggttgtgttcttaatggggacgagcagacacactgatctgaaca

SEQ ID NO: 542 - DNA, 50 bp, Artificial Sequence
  Synthetic
atttatttgtccttccagcacatgtagcagtgaagagaggctgccggatc

SEQ ID NO: 543 - DNA, 50 bp, Artificial Sequence
  Synthetic
tgttcagatcagtgtgtctgctcgtccccattaagaacacaaccacaatt

SEQ ID NO: 544 - DNA, 100 bp, Artificial Sequence
  Synthetic
cgacaggagtgggggtggccgctggagacaggtgaagaaacaagaaaactaagaaatccgagcggttggagggggagtctgtgtggatgggatggggacg

SEQ ID NO: 545 - DNA, 39 bp, Artificial Sequence
  Synthetic
agttttcttgtttcttcacctgtctccagcggccacccc

SEQ ID NO: 546 - DNA, 39 bp, Artificial Sequence
  Synthetic
catccacacagactccccctccaaccgctcggatttctt

SEQ ID NO: 547 - DNA, 100 bp, Artificial Sequence
  Synthetic
tgattttccctttccactggccatgcccgtatgttcctctctgcccactggctttagcagatgtcttgagtgcaccatgtccattcatagtagggattga

SEQ ID NO: 548 - DNA, 50 bp, Artificial Sequence
  Synthetic
cagtgggcagagaggaacatacgggcatggccagtggaaagggaaaatca

SEQ ID NO: 549 - DNA, 50 bp, Artificial Sequence
  Synthetic
tcaatccctactatgaatggacatggtgcactcaagacatctgctaaagc

SEQ ID NO: 550 - DNA, 100 bp, Artificial Sequence
  Synthetic
tgacccactggatgggacagccttttaattctgatgatcgtaacacagcatgtcatcatggactagtagctgacagcttgcaggcaagtatggaaaaaga

SEQ ID NO: 551 - DNA, 50 bp, Artificial Sequence
  Synthetic
tgctgtgttacgatcatcagaattaaaaggctgtcccatccagtgggtca

SEQ ID NO: 552 - DNA, 50 bp, Artificial Sequence
  Synthetic
tctttttccatacttgcctgcaagctgtcagctactagtccatgatgaca

SEQ ID NO: 553 - DNA, 100 bp, Artificial Sequence
  Synthetic
catcgtggtgcacggctctccctttgcttcttcggttgcagtcctcttgcttcttgcgcgtgcgtgtagcgcttttgcaaagccgcggaggtgaagtgaa

SEQ ID NO: 554 - DNA, 50 bp, Artificial Sequence
  Synthetic
gcaagaggactgcaaccgaagaagcaaagggagagccgtgcaccacgatg

SEQ ID NO: 555 - DNA, 50 bp, Artificial Sequence
  Synthetic
ttcacttcacctccgcggctttgcaaaagcgctacacgcacgcgcaagaa

SEQ ID NO: 556 - DNA, 100 bp, Artificial Sequence
  Synthetic
cctgcttcggagtcggcggtggtcgtccagaccgagtgttctttactttttgtttggttgaggtttcacgctagaaggtggctcaggatgtcttcatcac

SEQ ID NO: 557 - DNA, 50 bp, Artificial Sequence
  Synthetic
aaaagtaaagaacactcggtctggacgaccaccgccgactccgaagcagg

SEQ ID NO: 558 - DNA, 50 bp, Artificial Sequence
  Synthetic
gtgatgaagacatcctgagccaccttctagcgtgaaacctcaaccaaaca

SEQ ID NO: 559 - DNA, 100 bp, Artificial Sequence
  Synthetic
catcatcccagaggtggtgttcagtgtcagacctcttaatgggccagtgaataacactcactgctggcatttaatgtgcagtagtgaatgagtgaaggac

SEQ ID NO: 560 - DNA, 50 bp, Artificial Sequence
  Synthetic
tcactggcccattaagaggtctgacactgaacaccacctctgggatgatg

SEQ ID NO: 561 - DNA, 50 bp, Artificial Sequence
  Synthetic
gtccttcactcattcactactgcacattaaatgccagcagtgagtgttat

SEQ ID NO: 562 - DNA, 100 bp, Artificial Sequence
  Synthetic
tttcttccatgttttagaaaatgaggcctgtttggggaaggtaccctggtgatgtttttgctagacattagctgtagctgacagcataaggagagtcgca

SEQ ID NO: 563 - DNA, 50 bp, Artificial Sequence
  Synthetic
accagggtaccttccccaaacaggcctcattttctaaaacatggaagaaa

SEQ ID NO: 564 - DNA, 50 bp, Artificial Sequence
  Synthetic
tgcgactctccttatgctgtcagctacagctaatgtctagcaaaaacatc

SEQ ID NO: 565 - DNA, 100 bp, Artificial Sequence
  Synthetic
gcccggatgctgaagcaaaattcagagagattgcagaagcatatgaaacactctcagatgctaatagacgaaaagagtatgatacacttggacacagtgc

SEQ ID NO: 566 - DNA, 50 bp, Artificial Sequence
  Synthetic
tgtttcatatgcttctgcaatctctctgaattttgcttcagcatccgggc

SEQ ID NO: 567 - DNA, 50 bp, Artificial Sequence
  Synthetic
gcactgtgtccaagtgtatcatactcttttcgtctattagcatctgagag

SEQ ID NO: 568 - DNA, 100 bp, Artificial Sequence
  Synthetic
aggagattgtttgacttcacagacacgactcaggcttagtggcatgttggatggtcttgttaatgtaggatggatggactgtgccacccaggataacctt

SEQ ID NO: 569 - DNA, 50 bp, Artificial Sequence
  Synthetic
ccaacatgccactaagcctgagtcgtgtctgtgaagtcaaacaatctcct

SEQ ID NO: 570 - DNA, 50 bp, Artificial Sequence
  Synthetic
aaggttatcctgggtggcacagtccatccatcctacattaacaagaccat

SEQ ID NO: 571 - DNA, 100 bp, Artificial Sequence
  Synthetic
tggcaacagcgggctttcataacgccaacgattgctagactgggataatggcggtccctccatcgccttctgtggctggttgtgggccttagttttctgc

SEQ ID NO: 572 - DNA, 47 bp, Artificial Sequence
  Synthetic
cattatcccagtctagcaatcgttggcgttatgaaagcccgctgttg

SEQ ID NO: 573 - DNA, 50 bp, Artificial Sequence
  Synthetic
gcagaaaactaaggcccacaaccagccacagaaggcgatggagggaccgc

SEQ ID NO: 574 - DNA, 100 bp, Artificial Sequence
  Synthetic
ctgagcttaatcagctttgcacaatggaagaagtggacatgatcagactgcagctcaaactgcgaggaagtgtcagcgtgaaggttaatgctgggccaat

SEQ ID NO: 575 - DNA, 50 bp, Artificial Sequence
  Synthetic
cagtctgatcatgtccacttcttccattgtgcaaagctgattaagctcag

SEQ ID NO: 576 - DNA, 50 bp, Artificial Sequence
  Synthetic
attggcccagcattaaccttcacgctgacacttcctcgcagtttgagctg

SEQ ID NO: 577 - DNA, 100 bp, Artificial Sequence
  Synthetic
ttgtggattgtccttcagaccttagtcctcaggcatggtttctggtgcccactcctggaagccgctgttccctttctaccttcttaccagagcccaaggg

SEQ ID NO: 578 - DNA, 50 bp, Artificial Sequence
  Synthetic
gggcaccagaaaccatgcctgaggactaaggtctgaaggacaatccacaa

SEQ ID NO: 579 - DNA, 48 bp, Artificial Sequence
  Synthetic
cttgggctctggtaagaaggtagaaagggaacagcggcttccaggagt

SEQ ID NO: 580 - DNA, 100 bp, Artificial Sequence
  Synthetic
ccctgggcagccagcattcattgtaagttccctctttgaaaactggtgtgtgggtgttcagttctgtgtctggtgggtatggacagacagtaatctcctg

SEQ ID NO: 581 - DNA, 50 bp, Artificial Sequence
  Synthetic
cacaccagttttcaaagagggaacttacaatgaatgctggctgcccaggg

SEQ ID NO: 582 - DNA, 50 bp, Artificial Sequence
  Synthetic
caggagattactgtctgtccatacccaccagacacagaactgaacaccca

SEQ ID NO: 583 - DNA, 100 bp, Artificial Sequence
  Synthetic
gtctttagtgcttggattggtgggatgtttcggaatgggcattgtcgccaattttcaggagttagctgtgccagtggttcatgacgggggcgctcttttg

SEQ ID NO: 584 - DNA, 50 bp, Artificial Sequence
  Synthetic
tggcgacaatgcccattccgaaacatcccaccaatccaagcactaaagac

SEQ ID NO: 585 - DNA, 50 bp, Artificial Sequence
  Synthetic
caaaagagcgcccccgtcatgaaccactggcacagctaactcctgaaaat

SEQ ID NO: 586 - DNA, 100 bp, Artificial Sequence
  Synthetic
tcttcatctctctggactctgatctccttctcccttcccatctccaggccttctgtctgtcccagataaaggcgctgttctcccatcctccctaccccat

SEQ ID NO: 587 - DNA, 50 bp, Artificial Sequence
  Synthetic
ggcctggagatgggaagggagaaggagatcagagtccagagagatgaaga

SEQ ID NO: 588 - DNA, 46 bp, Artificial Sequence
  Synthetic
ggtagggaggatgggagaacagcgcctttatctgggacagacagaa

SEQ ID NO: 589 - DNA, 100 bp, Artificial Sequence
  Synthetic
tcagggaccctgtgtaggatctcgtttgtggtgagtgggctgctctgaggtctccactgggctgccatttagccatgtgccatctctgaagtcagaggtg

SEQ ID NO: 590 - DNA, 41 bp, Artificial Sequence
  Synthetic
cctcagagcagcccactcaccacaaacgagatcctacacag

SEQ ID NO: 591 - DNA, 44 bp, Artificial Sequence
  Synthetic
tgacttcagagatggcacatggctaaatggcagcccagtggaga

SEQ ID NO: 592 - DNA, 100 bp, Artificial Sequence
  Synthetic
ctcgtgcgcttagtccggagccctgatctgcgaacaggatattaaaacttttagtacaattgattggactacttgaaccatcgggatttggggaggaact

SEQ ID NO: 593 - DNA, 50 bp, Artificial Sequence
  Synthetic
aagttttaatatcctgttcgcagatcagggctccggactaagcgcacgag

SEQ ID NO: 594 - DNA, 50 bp, Artificial Sequence
  Synthetic
agttcctccccaaatcccgatggttcaagtagtccaatcaattgtactaa

SEQ ID NO: 595 - DNA, 100 bp, Artificial Sequence
  Synthetic
tgctttttgcaaccaaagctgtggacagaaaagcctccttaagtgagctgaggggacaggaaatccaatcagatgacctttgtgttcgtaatcgggcttg

SEQ ID NO: 596 - DNA, 50 bp, Artificial Sequence
  Synthetic
cagctcacttaaggaggcttttctgtccacagctttggttgcaaaaagca

SEQ ID NO: 597 - DNA, 50 bp, Artificial Sequence
  Synthetic
caagcccgattacgaacacaaaggtcatctgattggatttcctgtcccct

SEQ ID NO: 598 - DNA, 100 bp, Artificial Sequence
  Synthetic
gtctaccccggtgcctacaatgcctttcagatccgtgctggaaactcgcagggggacttttacattaggcaaatcaacaacgtcagcgccatgctggtcc

SEQ ID NO: 599 - DNA, 50 bp, Artificial Sequence
  Synthetic
tgcgagtttccagcacggatctgaaaggcattgtaggcaccggggtagac

SEQ ID NO: 600 - DNA, 50 bp, Artificial Sequence
  Synthetic
ggaccagcatggcgctgacgttgttgatttgcctaatgtaaaagtccccc

SEQ ID NO: 601 - DNA, 100 bp, Artificial Sequence
  Synthetic
gcagggccttcctcctcttcctcctccccttcctcgggaggctccccagaccctggcatgggatgggctgggatcttctctgtgaatccacccctggcta

SEQ ID NO: 602 - DNA, 38 bp, Artificial Sequence
  Synthetic
tctggggagcctcccgaggaaggggaggaggaagagga

SEQ ID NO: 603 - DNA, 38 bp, Artificial Sequence
  Synthetic
gattcacagagaagatcccagcccatcccatgccaggg

SEQ ID NO: 604 - DNA, 100 bp, Artificial Sequence
  Synthetic
gacgacgaggccgagtgggtggtgaccaaggacaagtccaaatacgacgagatcttctacaacctggcgcctgccgacggcaagctgagcggctccaagg

SEQ ID NO: 605 - DNA, 41 bp, Artificial Sequence
  Synthetic
tcgtcgtatttggacttgtccttggtcaccacccactcggc

SEQ ID NO: 606 - DNA, 35 bp, Artificial Sequence
  Synthetic
gcttgccgtcggcaggcgccaggttgtagaagatc

SEQ ID NO: 607 - DNA, 100 bp, Artificial Sequence
  Synthetic
agggccagaagctgttctttcccttaaaagggcaaactcatttccacactatggggactctgacagatagcataccttcctgtctatggctattggacct

SEQ ID NO: 608 - DNA, 50 bp, Artificial Sequence
  Synthetic
agtgtggaaatgagtttgcccttttaagggaaagaacagcttctggccct

SEQ ID NO: 609 - DNA, 45 bp, Artificial Sequence
  Synthetic
caatagccatagacaggaaggtatgctatctgtcagagtccccat

SEQ ID NO: 610 - DNA, 100 bp, Artificial Sequence
  Synthetic
aatcccgcaaccgaagcacaaaagttatcaaacccggtggaccatatgtagggaaaagagtgcaaattcggaaagcacctcaagctgtttcagatacagt

SEQ ID NO: 611 - DNA, 50 bp, Artificial Sequence
  Synthetic
tacatatggtccaccgggtttgataacttttgtgcttcggttgcgggatt

SEQ ID NO: 612 - DNA, 50 bp, Artificial Sequence
  Synthetic
actgtatctgaaacagcttgaggtgctttccgaatttgcactcttttccc

SEQ ID NO: 613 - DNA, 100 bp, Artificial Sequence
  Synthetic
ccggagactacgaaatcctctactgggttccctctgcctgtaagcaagtcgtaagtgtggaaactacaagagacattgaatgggctacctatacctgcac

SEQ ID NO: 614 - DNA, 50 bp, Artificial Sequence
  Synthetic
gacttgcttacaggcagagggaacccagtagaggatttcgtagtctccgg

SEQ ID NO: 615 - DNA, 50 bp, Artificial Sequence
  Synthetic
gtgcaggtataggtagcccattcaatgtctcttgtagtttccacacttac

SEQ ID NO: 616 - DNA, 100 bp, Artificial Sequence
  Synthetic
ttcaaagaccaccaggctcccttgaccacctctgagatcaagctgaagatgaattctcgagtcgttgggggcataatgactggagagaagaaagacggct

SEQ ID NO: 617 - DNA, 38 bp, Artificial Sequence
  Synthetic
atcttcagcttgatctcagaggtggtcaagggagcctg

SEQ ID NO: 618 - DNA, 50 bp, Artificial Sequence
  Synthetic
agccgtctttcttctctccagtcattatgcccccaacgactcgagaattc

SEQ ID NO: 619 - DNA, 100 bp, Artificial Sequence
  Synthetic
ttctcgcctcactttccaccaagtgtctagagtcatgtgagcctcgtgtcatctccggggtggccacaggctagatccccggtggttttgtgctcaaaat

SEQ ID NO: 620 - DNA, 50 bp, Artificial Sequence
  Synthetic
gacacgaggctcacatgactctagacacttggtggaaagtgaggcgagaa

SEQ ID NO: 621 - DNA, 50 bp, Artificial Sequence
  Synthetic
attttgagcacaaaaccaccggggatctagcctgtggccaccccggagat

SEQ ID NO: 622 - DNA, 100 bp, Artificial Sequence
  Synthetic
ctttttatgagccatcccatgcagaggaggtgtcaaagttttctgtttgtggctttgctaatccattgcccacagagtctcttgactgtttctgccctca

SEQ ID NO: 623 - DNA, 50 bp, Artificial Sequence
  Synthetic
acaaacagaaaactttgacacctcctctgcatgggatggctcataaaaag

SEQ ID NO: 624 - DNA, 50 bp, Artificial Sequence
  Synthetic
tgagggcagaaacagtcaagagactctgtgggcaatggattagcaaagcc

SEQ ID NO: 625 - DNA, 100 bp, Artificial Sequence
  Synthetic
ttcgagtaactttaggaaaatgagctgctggactcctcagtcaatctgtcctttctagtcaatgaaaaagacagggtttgaggttccttccgaaacgggg

SEQ ID NO: 626 - DNA, 50 bp, Artificial Sequence
  Synthetic
gacagattgactgaggagtccagcagctcattttcctaaagttactcgaa

SEQ ID NO: 627 - DNA, 50 bp, Artificial Sequence
  Synthetic
ccccgtttcggaaggaacctcaaaccctgtctttttcattgactagaaag

SEQ ID NO: 628 - DNA, 100 bp, Artificial Sequence
  Synthetic
ccagccaggcccaacagagcagtcctggattaggtttgataaatagcatggtcaaaagcccaatgacacaggcaggcttgacttctcccaacatggggat

SEQ ID NO: 629 - DNA, 50 bp, Artificial Sequence
  Synthetic
catgctatttatcaaacctaatccaggactgctctgttgggcctggctgg

SEQ ID NO: 630 - DNA, 47 bp, Artificial Sequence
  Synthetic
cccatgttgggagaagtcaagcctgcctgtgtcattgggcttttgac

SEQ ID NO: 631 - DNA, 100 bp, Artificial Sequence
  Synthetic
gcagcggccggggtcgtgttcgttgtgtccttggtggccatctctatcgtctgtagcaggaaacgggcttatagcaaagaggctgtgtacagcgataagc

SEQ ID NO: 632 - DNA, 49 bp, Artificial Sequence
  Synthetic
acgatagagatggccaccaaggacacaacgaacacgaccccggccgctg

SEQ ID NO: 633 - DNA, 50 bp, Artificial Sequence
  Synthetic
gcttatcgctgtacacagcctctttgctataagcccgtttcctgctacag

SEQ ID NO: 634 - DNA, 100 bp, Artificial Sequence
  Synthetic
agagaagcatttagagagcatcagcaatacaaaaccgctgagttcttgagcaaactgaacacagaatcgccagacagaagtgcctgtcaaagtgctgttt

SEQ ID NO: 635 - DNA, 50 bp, Artificial Sequence
  Synthetic
ctcaagaactcagcggttttgtattgctgatgctctctaaatgcttctct

SEQ ID NO: 636 - DNA, 50 bp, Artificial Sequence
  Synthetic
aaacagcactttgacaggcacttctgtctggcgattctgtgttcagtttg

SEQ ID NO: 637 - DNA, 100 bp, Artificial Sequence
  Synthetic
cacagagacccctttctgcacgaacatacagcatagatggtccaaatgcatcaagacctcagagtgctcgaccctctattaatgaaataccagagagaac

SEQ ID NO: 638 - DNA, 50 bp, Artificial Sequence
  Synthetic
tgcatttggaccatctatgctgtatgttcgtgcagaaaggggtctctgtg

SEQ ID NO: 639 - DNA, 50 bp, Artificial Sequence
  Synthetic
gttctctctggtatttcattaatagagggtcgagcactctgaggtcttga

SEQ ID NO: 640 - DNA, 100 bp, Artificial Sequence
  Synthetic
gacctcatcattatgtgggggctttgttctccacagggtcaggtaagagatggccttcttggctgccacaatcagaaatcacgcaggcattttgggtagg

SEQ ID NO: 641 - DNA, 50 bp, Artificial Sequence
  Synthetic
tctcttacctgaccctgtggagaacaaagcccccacataatgatgaggtc

SEQ ID NO: 642 - DNA, 50 bp, Artificial Sequence
  Synthetic
cctacccaaaatgcctgcgtgatttctgattgtggcagccaagaaggcca

SEQ ID NO: 643 - DNA, 100 bp, Artificial Sequence
  Synthetic
atcgaaggaccaatgtacgtcacagaaatggcctttctctctgacccagcagatggcagcctgtacatcttggggacccaaaaacaacagggattaatga

SEQ ID NO: 644 - DNA, 50 bp, Artificial Sequence
  Synthetic
gctgggtcagagagaaaggccatttctgtgacgtacattggtccttcgat

SEQ ID NO: 645 - DNA, 50 bp, Artificial Sequence
  Synthetic
tcattaatccctgttgtttttgggtccccaagatgtacaggctgccatct

SEQ ID NO: 646 - DNA, 100 bp, Artificial Sequence
  Synthetic
taacctgctggctgtgagtcccttgtggaatataagggggtagtgggaaaagtggtactaacccacgattctgagccctgagtatgcctggacattgatg

SEQ ID NO: 647 - DNA, 40 bp, Artificial Sequence
  Synthetic
tttcccactacccccttatattccacaagggactcacagc

SEQ ID NO: 648 - DNA, 40 bp, Artificial Sequence
  Synthetic
caggcatactcagggctcagaatcgtgggttagtaccact

SEQ ID NO: 649 - DNA, 100 bp, Artificial Sequence
  Synthetic
tgaggaagtattacttagcattcatgcatattgggcttaggctctagccctgccactatcattgtcttctctggactgtgaagtcactgaggacaaggaa

SEQ ID NO: 650 - DNA, 50 bp, Artificial Sequence
  Synthetic
gggctagagcctaagcccaatatgcatgaatgctaagtaatacttcctca

SEQ ID NO: 651 - DNA, 47 bp, Artificial Sequence
  Synthetic
cttgtcctcagtgacttcacagtccagagaagacaatgatagtggca

SEQ ID NO: 652 - DNA, 100 bp, Artificial Sequence
  Synthetic
cagggacttcacctctacactgtggtggtttatgactttgcccaaggctgtcagatagttgatttggctgacctgacccaactagtggacagttgtaaat

SEQ ID NO: 653 - DNA, 47 bp, Artificial Sequence
  Synthetic
cagccttgggcaaagtcataaaccaccacagtgtagaggtgaagtcc

SEQ ID NO: 654 - DNA, 50 bp, Artificial Sequence
  Synthetic
atttacaactgtccactagttgggtcaggtcagccaaatcaactatctga

SEQ ID NO: 655 - DNA, 100 bp, Artificial Sequence
  Synthetic
gtatgaatatgaaatcagagaccagggcatgatgttgctaggattagagcctctcagtctggcctcttcacccaagtgcaagaactcagtctcttactgt

SEQ ID NO: 656 - DNA, 50 bp, Artificial Sequence
  Synthetic
gctctaatcctagcaacatcatgccctggtctctgatttcatattcatac

SEQ ID NO: 657 - DNA, 50 bp, Artificial Sequence
  Synthetic
acagtaagagactgagttcttgcacttgggtgaagaggccagactgagag

SEQ ID NO: 658 - DNA, 100 bp, Artificial Sequence
  Synthetic
gccagagccagtgggctgagcaagaagccggcaagcatccagaagagaaagcatcataatgccgagaacaagccggggttacagatcaaactcaatgagc

SEQ ID NO: 659 - DNA, 42 bp, Artificial Sequence
  Synthetic
tttctcttctggatgcttgccggcttcttgctcagcccactg

SEQ ID NO: 660 - DNA, 50 bp, Artificial Sequence
  Synthetic
gctcattgagtttgatctgtaaccccggcttgttctcggcattatgatgc

SEQ ID NO: 661 - DNA, 100 bp, Artificial Sequence
  Synthetic
ggtggaatgcgtcatgaaaggcgtcacttccacgagagtttatgagagagcataagccaagggacgttgacctggactgaagttcgcattgaactctaca

SEQ ID NO: 662 - DNA, 50 bp, Artificial Sequence
  Synthetic
ctctctcataaactctcgtggaagtgacgcctttcatgacgcattccacc

SEQ ID NO: 663 - DNA, 48 bp, Artificial Sequence
  Synthetic
tagagttcaatgcgaacttcagtccaggtcaacgtcccttggcttatg

SEQ ID NO: 664 - DNA, 100 bp, Artificial Sequence
  Synthetic
tctgacattcatgcaggacttgccctgttgccaccaatgttctcggtatttcacatgcagctctctttctgccactggatacatgggttcaatccatttg

SEQ ID NO: 665 - DNA, 50 bp, Artificial Sequence
  Synthetic
aataccgagaacattggtggcaacagggcaagtcctgcatgaatgtcaga

SEQ ID NO: 666 - DNA, 50 bp, Artificial Sequence
  Synthetic
caaatggattgaacccatgtatccagtggcagaaagagagctgcatgtga

SEQ ID NO: 667 - DNA, 100 bp, Artificial Sequence
  Synthetic
acagctacatgtggtggctcagcattggcgctctcataggcctgtccgtagcagcagtggttcttctcgccttcattgttaccgcctgtgtgctctgcta

SEQ ID NO: 668 - DNA, 40 bp, Artificial Sequence
  Synthetic
tacggacaggcctatgagagcgccaatgctgagccaccac

SEQ ID NO: 669 - DNA, 50 bp, Artificial Sequence
  Synthetic
tagcagagcacacaggcggtaacaatgaaggcgagaagaaccactgctgc

SEQ ID NO: 670 - DNA, 100 bp, Artificial Sequence
  Synthetic
cttttctccacaccggaacaattacatactgctaagtcagctactttgccaagaaagggacagttagtctatggccaattgatggaaccagtaaatcgag

SEQ ID NO: 671 - DNA, 50 bp, Artificial Sequence
  Synthetic
ggcaaagtagctgacttagcagtatgtaattgttccggtgtggagaaaag

SEQ ID NO: 672 - DNA, 50 bp, Artificial Sequence
  Synthetic
ctcgatttactggttccatcaattggccatagactaactgtccctttctt

SEQ ID NO: 673 - DNA, 100 bp, Artificial Sequence
  Synthetic
cagtgaactctctggttttatctggcgtgcagcaccttgaactgagcagtgttgcacaaatgtgaatacagcaacaggcgacacttacgtcacctaaaga

SEQ ID NO: 674 - DNA, 50 bp, Artificial Sequence
  Synthetic
actgctcagttcaaggtgctgcacgccagataaaaccagagagttcactg

SEQ ID NO: 675 - DNA, 50 bp, Artificial Sequence
  Synthetic
tctttaggtgacgtaagtgtcgcctgttgctgtattcacatttgtgcaac

SEQ ID NO: 676 - DNA, 100 bp, Artificial Sequence
  Synthetic
ttggaatgggtctacagtgtatcatgagccaaccctcaaaggacccgtattacagtgccacgttggaaaacgctacaggaagcatgacctatccacatct

SEQ ID NO: 677 - DNA, 50 bp, Artificial Sequence
  Synthetic
atacgggtcctttgagggttggctcatgatacactgtagacccattccaa

SEQ ID NO: 678 - DNA, 50 bp, Artificial Sequence
  Synthetic
agatgtggataggtcatgcttcctgtagcgttttccaacgtggcactgta

SEQ ID NO: 679 - DNA, 100 bp, Artificial Sequence
  Synthetic
gtgccagagacaaacctgaaagaacttattaaggatcgtcactgtgagtctgatttggactgtgtctatggcacagattgtagaactagctgtgatcaga

SEQ ID NO: 680 - DNA, 50 bp, Artificial Sequence
  Synthetic
gactcacagtgacgatccttaataagttctttcaggtttgtctctggcac

SEQ ID NO: 681 - DNA, 50 bp, Artificial Sequence
  Synthetic
tctgatcacagctagttctacaatctgtgccatagacacagtccaaatca

SEQ ID NO: 682 - DNA, 100 bp, Artificial Sequence
  Synthetic
cacgttgattgatggcatccgcgtggcaacaggctcctacagttttacatggacggatggcaaattaaacagcagtaacttggtaattctgtctggccaa

SEQ ID NO: 683 - DNA, 50 bp, Artificial Sequence
  Synthetic
atgtaaaactgtaggagcctgttgccacgcggatgccatcaatcaacgtg

SEQ ID NO: 684 - DNA, 50 bp, Artificial Sequence
  Synthetic
ttggccagacagaattaccaagttactgctgtttaatttgccatccgtcc

SEQ ID NO: 685 - DNA, 100 bp, Artificial Sequence
  Synthetic
gcattggaagctatcctccaagcaagaagtgtgttacttgccatctaaggaaagaaaggtgccaatattacacagcaagtttcagcgactacgccaagta

SEQ ID NO: 686 - DNA, 50 bp, Artificial Sequence
  Synthetic
ccttagatggcaagtaacacacttcttgcttggaggatagcttccaatgc

SEQ ID NO: 687 - DNA, 50 bp, Artificial Sequence
  Synthetic
tacttggcgtagtcgctgaaacttgctgtgtaatattggcacctttcttt

SEQ ID NO: 688 - DNA, 100 bp, Artificial Sequence
  Synthetic
tctttcaggagctataaaagaaagggaggaatcatgtccacaattgcagctttctatggcggcaagtccattctcatcacgggggccacaggctttctgg

SEQ ID NO: 689 - DNA, 50 bp, Artificial Sequence
  Synthetic
gctgcaattgtggacatgattcctccctttcttttatagctcctgaaaga

SEQ ID NO: 690 - DNA, 49 bp, Artificial Sequence
  Synthetic
cagaaagcctgtggcccccgtgatgagaatggacttgccgccatagaaa

SEQ ID NO: 691 - DNA, 100 bp, Artificial Sequence
  Synthetic
tcatggtacgtagtccccggcacctgtcgttattcctatatcctcctgcaactgtggtttgaaactgcgcattctctagtagtatatatcgtgcctgtct

SEQ ID NO: 692 - DNA, 50 bp, Artificial Sequence
  Synthetic
tgcaggaggatataggaataacgacaggtgccggggactacgtaccatga

SEQ ID NO: 693 - DNA, 50 bp, Artificial Sequence
  Synthetic
agacaggcacgatatatactactagagaatgcgcagtttcaaaccacagt

SEQ ID NO: 694 - DNA, 100 bp, Artificial Sequence
  Synthetic
caccggggcttttcgtgagctcgtctctgatctcgcgcaagagtgacacacaggtgttcaaagacgcttctggggagtgagggaagcggtttacgagtga

SEQ ID NO: 695 - DNA, 48 bp, Artificial Sequence
  Synthetic
tgtgtcactcttgcgcgagatcagagacgagctcacgaaaagccccgg

SEQ ID NO: 696 - DNA, 50 bp, Artificial Sequence
  Synthetic
tcactcgtaaaccgcttccctcactccccagaagcgtctttgaacacctg

SEQ ID NO: 697 - DNA, 100 bp, Artificial Sequence
  Synthetic
agatgaggtgaagaaactggatgtgctatccaattccctggtgatcaacatggtccaatcctcctatagtacctgcgtcctggtctcagaagagaataag

SEQ ID NO: 698 - DNA, 45 bp, Artificial Sequence
  Synthetic
tgttgatcaccagggaattggatagcacatccagtttcttcacct

SEQ ID NO: 699 - DNA, 49 bp, Artificial Sequence
  Synthetic
ttattctcttctgagaccaggacgcaggtactataggaggattggacca

SEQ ID NO: 700 - DNA, 100 bp, Artificial Sequence
  Synthetic
acgatgcgactcctgccgaggcacttccacaacttacagaatcttagtttggcttattgcagacggttcacagacaaaggcttacagtacctgaacttgg

SEQ ID NO: 701 - DNA, 50 bp, Artificial Sequence
  Synthetic
aaactaagattctgtaagttgtggaagtgcctcggcaggagtcgcatcgt

SEQ ID NO: 702 - DNA, 50 bp, Artificial Sequence
  Synthetic
ccaagttcaggtactgtaagcctttgtctgtgaaccgtctgcaataagcc

SEQ ID NO: 703 - DNA, 100 bp, Artificial Sequence
  Synthetic
tcagctccacagcccatagcaagaagaaagtgggcaatgtttttcagggagaagggatagaagctggtgggtttccagtcactcgaagtctataaagatt

SEQ ID NO: 704 - DNA, 46 bp, Artificial Sequence
  Synthetic
tccctgaaaaacattgcccactttcttcttgctatgggctgtggag

SEQ ID NO: 705 - DNA, 50 bp, Artificial Sequence
  Synthetic
aatctttatagacttcgagtgactggaaacccaccagcttctatcccttc

SEQ ID NO: 706 - DNA, 100 bp, Artificial Sequence
  Synthetic
tgcagatatggttgcagaagaatcaggtcctggtgcacaaaatagtccataccaacttcgtagaaaaactcttttgccgaaaagaacagcgtgtcccaca

SEQ ID NO: 707 - DNA, 50 bp, Artificial Sequence
  Synthetic
atggactattttgtgcaccaggacctgattcttctgcaaccatatctgca

SEQ ID NO: 708 - DNA, 50 bp, Artificial Sequence
  Synthetic
tgtgggacacgctgttcttttcggcaaaagagtttttctacgaagttggt

SEQ ID NO: 709 - DNA, 100 bp, Artificial Sequence
  Synthetic
agcaaagactattaccagttactggtcacccggtctcaggtaatctttagatggtggaagatctctctaaggagtgagtatcgatcaacaaaacctggag

SEQ ID NO: 710 - DNA, 50 bp, Artificial Sequence
  Synthetic
ctaaagattacctgagaccgggtgaccagtaactggtaatagtctttgct

SEQ ID NO: 711 - DNA, 47 bp, Artificial Sequence
  Synthetic
caggttttgttgatcgatactcactccttagagagatcttccaccat

SEQ ID NO: 712 - DNA, 100 bp, Artificial Sequence
  Synthetic
tttgttctctcctcggggatgagctctgctgctgagtagggagcttttgcttgctgggaggctctatgcatggatttttttggtgaccatacagctaggg

SEQ ID NO: 713 - DNA, 50 bp, Artificial Sequence
  Synthetic
gcaaaagctccctactcagcagcagagctcatccccgaggagagaacaaa

SEQ ID NO: 714 - DNA, 50 bp, Artificial Sequence
  Synthetic
ccctagctgtatggtcaccaaaaaaatccatgcatagagcctcccagcaa

SEQ ID NO: 715 - DNA, 100 bp, Artificial Sequence
  Synthetic
aacttggaaagccaccacggtgaccagatggcgcagaaatcccagtccacgcagatttcacaggaactggaggaacttcgagctgaacagcagagattga

SEQ ID NO: 716 - DNA, 35 bp, Artificial Sequence
  Synthetic
gtggactgggatttctgcgccatctggtcaccgtg

SEQ ID NO: 717 - DNA, 48 bp, Artificial Sequence
  Synthetic
aatctctgctgttcagctcgaagttcctccagttcctgtgaaatctgc

SEQ ID NO: 718 - DNA, 100 bp, Artificial Sequence
  Synthetic
accaggacaatgatcttaacaccggaaattgtgctgtgatgtttcagggagcttggtggtacaaaaactgccatgtgtcaaacctgaatggtcgctacct

SEQ ID NO: 719 - DNA, 50 bp, Artificial Sequence
  Synthetic
tccctgaaacatcacagcacaatttccggtgttaagatcattgtcctggt

SEQ ID NO: 720 - DNA, 47 bp, Artificial Sequence
  Synthetic
tagcgaccattcaggtttgacacatggcagtttttgtaccaccaagc

SEQ ID NO: 721 - DNA, 100 bp, Artificial Sequence
  Synthetic
taaacgtgtatagcttaacctggattaaacacgagcaagcgcgcggggtcctttgccgttggcttctagtgctagtaatcattggatgcatgatggggca

SEQ ID NO: 722 - DNA, 50 bp, Artificial Sequence
  Synthetic
gaccccgcgcgcttgctcgtgtttaatccaggttaagctatacacgttta

SEQ ID NO: 723 - DNA, 50 bp, Artificial Sequence
  Synthetic
tgccccatcatgcatccaatgattactagcactagaagccaacggcaaag

SEQ ID NO: 724 - DNA, 100 bp, Artificial Sequence
  Synthetic
caattcagcaggatcgaggaggtgttcaaagaagtccaaaacctcaaggaaatcgtaaatagtctaaagaaatcttgccaagactgcaagctgcaggctg

SEQ ID NO: 725 - DNA, 50 bp, Artificial Sequence
  Synthetic
tccttgaggttttggacttctttgaacacctcctcgatcctgctgaattg

SEQ ID NO: 726 - DNA, 50 bp, Artificial Sequence
  Synthetic
cagcctgcagcttgcagtcttggcaagatttctttagactatttacgatt

SEQ ID NO: 727 - DNA, 100 bp, Artificial Sequence
  Synthetic
aaagcaggtgattccaggtctggagcagagtcttctcgacatgtgtgtgggagagaagcgaagggcaatcattccttctcacttggcctatggaaaacgg

SEQ ID NO: 728 - DNA, 46 bp, Artificial Sequence
  Synthetic
ccacacacatgtcgagaagactctgctccagacctggaatcacctg

SEQ ID NO: 729 - DNA, 45 bp, Artificial Sequence
  Synthetic
ttccataggccaagtgagaaggaatgattgcccttcgcttctctc

SEQ ID NO: 730 - DNA, 100 bp, Artificial Sequence
  Synthetic
ccacggccacgggggccgagggcaaaaggaagctgcagatcggggtcaagaagcgggtggaccactgtcccatcaaatcgcgcaaaggggatgtcctgca

SEQ ID NO: 731 - DNA, 35 bp, Artificial Sequence
  Synthetic
cttgaccccgatctgcagcttccttttgccctcgg

SEQ ID NO: 732 - DNA, 39 bp, Artificial Sequence
  Synthetic
ccctttgcgcgatttgatgggacagtggtccacccgctt

SEQ ID NO: 733 - DNA, 100 bp, Artificial Sequence
  Synthetic
tcccattcttactggctgaaattcaaagctgataaatggagctagagcagatagctgggaaaatgagttgagggtcttacattaagacttgccagcaaga

SEQ ID NO: 734 - DNA, 50 bp, Artificial Sequence
  Synthetic
ctgctctagctccatttatcagctttgaatttcagccagtaagaatggga

SEQ ID NO: 735 - DNA, 50 bp, Artificial Sequence
  Synthetic
tcttgctggcaagtcttaatgtaagaccctcaactcattttcccagctat

SEQ ID NO: 736 - DNA, 100 bp, Artificial Sequence
  Synthetic
ccctcaggagccctggaggagtgctatgtcacagaaattgaccaagataagtatgctgtgcgcttcatccctcgggagaatggcgtttacctgattgacg

SEQ ID NO: 737 - DNA, 48 bp, Artificial Sequence
  Synthetic
ttatcttggtcaatttctgtgacatagcactcctccagggctcctgag

SEQ ID NO: 738 - DNA, 50 bp, Artificial Sequence
  Synthetic
cgtcaatcaggtaaacgccattctcccgagggatgaagcgcacagcatac

SEQ ID NO: 739 - DNA, 100 bp, Artificial Sequence
  Synthetic
gggaatggacatgcattgcctactcgcagcttcgagatcagtgcattgttgatgacatcacttacaatgtgaacgacacattccacaagcgtcatgaaga

SEQ ID NO: 740 - DNA, 50 bp, Artificial Sequence
  Synthetic
aacaatgcactgatctcgaagctgcgagtaggcaatgcatgtccattccc

SEQ ID NO: 741 - DNA, 50 bp, Artificial Sequence
  Synthetic
tcttcatgacgcttgtggaatgtgtcgttcacattgtaagtgatgtcatc

SEQ ID NO: 742 - DNA, 100 bp, Artificial Sequence
  Synthetic
catgacctccaaacccaaaatccactgcttcaggagcctaaagcgtgggctttctctcaagctgggtgcaacaccggaggatttcagcaacctcccacct

SEQ ID NO: 743 - DNA, 50 bp, Artificial Sequence
  Synthetic
gcccacgctttaggctcctgaagcagtggattttgggtttggaggtcatg

SEQ ID NO: 744 - DNA, 48 bp, Artificial Sequence
  Synthetic
gtgggaggttgctgaaatcctccggtgttgcacccagcttgagagaaa

SEQ ID NO: 745 - DNA, 100 bp, Artificial Sequence
  Synthetic
gattataagcagatcgctaacaggcgtgtgctgattgagaacctgattccagacactgtgtatgaatttgcagtccgtatttcacagggtgaaagagatg

SEQ ID NO: 746 - DNA, 50 bp, Artificial Sequence
  Synthetic
ggaatcaggttctcaatcagcacacgcctgttagcgatctgcttataatc

SEQ ID NO: 747 - DNA, 50 bp, Artificial Sequence
  Synthetic
catctctttcaccctgtgaaatacggactgcaaattcatacacagtgtct

SEQ ID NO: 748 - DNA, 100 bp, Artificial Sequence
  Synthetic
aagtcttttgtattgggtcaggagttgaatttggggtgggaggatggatgcaactgaagcagagtgtgggtgcccagatgtgcgctattagatgtttctc

SEQ ID NO: 749 - DNA, 50 bp, Artificial Sequence
  Synthetic
catccatcctcccaccccaaattcaactcctgacccaatacaaaagactt

SEQ ID NO: 750 - DNA, 50 bp, Artificial Sequence
  Synthetic
gagaaacatctaatagcgcacatctgggcacccacactctgcttcagttg

SEQ ID NO: 751 - DNA, 100 bp, Artificial Sequence
  Synthetic
tctcatcaccaacatcattaactgtttcgacccagtcctcacctggcaccatgatgcagcagacgccgtgctactcgtttgcgccaccaaacaccagttt

SEQ ID NO: 752 - DNA, 50 bp, Artificial Sequence
  Synthetic
ggtgccaggtgaggactgggtcgaaacagttaatgatgttggtgatgaga

SEQ ID NO: 753 - DNA, 50 bp, Artificial Sequence
  Synthetic
aaactggtgtttggtggcgcaaacgagtagcacggcgtctgctgcatcat

SEQ ID NO: 754 - DNA, 100 bp, Artificial Sequence
  Synthetic
tgctagccaaaaggcttccctctgtgtgttgcagtcctgtggcattatgcatgccccctcccagtgaccccaggctttttatggctgtgagacacgttaa

SEQ ID NO: 755 - DNA, 50 bp, Artificial Sequence
  Synthetic
gcataatgccacaggactgcaacacacagagggaagccttttggctagca

SEQ ID NO: 756 - DNA, 35 bp, Artificial Sequence
  Synthetic
gccataaaaagcctggggtcactgggagggggcat

SEQ ID NO: 757 - DNA, 100 bp, Artificial Sequence
  Synthetic
ccctgccctcttgtctgccacggggcgagtctggcacctctttcttctgacctcagacggctctgagccttatttctctggaagcggctaagggacggtt

SEQ ID NO: 758 - DNA, 43 bp, Artificial Sequence
  Synthetic
tcagaagaaagaggtgccagactcgccccgtggcagacaagag

SEQ ID NO: 759 - DNA, 43 bp, Artificial Sequence
  Synthetic
ccttagccgcttccagagaaataaggctcagagccgtctgagg

SEQ ID NO: 760 - DNA, 100 bp, Artificial Sequence
  Synthetic
gacatcatgaaaggattctgatggcaattactgtctcattagtgaacaataaaagaaaaattgttgtattagcacaacctactactgtgaagaggaaaag

SEQ ID NO: 761 - DNA, 50 bp, Artificial Sequence
  Synthetic
attgttcactaatgagacagtaattgccatcagaatcctttcatgatgtc

SEQ ID NO: 762 - DNA, 50 bp, Artificial Sequence
  Synthetic
cttttcctcttcacagtagtaggttgtgctaatacaacaatttttctttt

SEQ ID NO: 763 - DNA, 100 bp, Artificial Sequence
  Synthetic
atgtaaagtccctcatggcgaaatataacacggggggcaacccgacagaggatgtctcagtcaatagccgacccttcagagtcacagggccaaactcatc

SEQ ID NO: 764 - DNA, 50 bp, Artificial Sequence
  Synthetic
ctctgtcgggttgccccccgtgttatatttcgccatgagggactttacat

SEQ ID NO: 765 - DNA, 50 bp, Artificial Sequence
  Synthetic
gatgagtttggccctgtgactctgaagggtcggctattgactgagacatc

SEQ ID NO: 766 - DNA, 100 bp, Artificial Sequence
  Synthetic
tgtatgccatgatgatcgcacgctttaagatgttcccagaagtcaaggagaaaggaatggctgctcttcccaggctcattgccttcacgtctgaacatag

SEQ ID NO: 767 - DNA, 50 bp, Artificial Sequence
  Synthetic
ctccttgacttctgggaacatcttaaagcgtgcgatcatcatggcataca

SEQ ID NO: 768 - DNA, 45 bp, Artificial Sequence
  Synthetic
ttcagacgtgaaggcaatgagcctgggaagagcagccattccttt

SEQ ID NO: 769 - DNA, 100 bp, Artificial Sequence
  Synthetic
tgcggaaggatggtattcagactcgaaaccgcaaggcatctggaaaagggaaaaagaaacggggctccagtctgggaggcacaggagcagccgaaggacc

SEQ ID NO: 770 - DNA, 50 bp, Artificial Sequence
  Synthetic
cccttttccagatgccttgcggtttcgagtctgaataccatccttccgca

SEQ ID NO: 771 - DNA, 37 bp, Artificial Sequence
  Synthetic
ctcctgtgcctcccagactggagccccgtttcttttt

SEQ ID NO: 772 - DNA, 100 bp, Artificial Sequence
  Synthetic
gaagaaggaagggatccagactcggaaccggaagatgtccaacaagtccaagaagagcaagaaaggggcggagtgcttcgaggagctgtcaaagtgcatg

SEQ ID NO: 773 - DNA, 50 bp, Artificial Sequence
  Synthetic
tggacttgttggacatcttccggttccgagtctggatcccttccttcttc

SEQ ID NO: 774 - DNA, 50 bp, Artificial Sequence
  Synthetic
catgcactttgacagctcctcgaagcactccgcccctttcttgctcttct

SEQ ID NO: 775 - DNA, 100 bp, Artificial Sequence
  Synthetic
ccagatgaccagcagtagacaaatggatactgagcagagtcttaggtaaaagtcttgggaaatatttgggcattggtctggccaagtctacaatgtccca

SEQ ID NO: 776 - DNA, 50 bp, Artificial Sequence
  Synthetic
tttacctaagactctgctcagtatccatttgtctactgctggtcatctgg

SEQ ID NO: 777 - DNA, 50 bp, Artificial Sequence
  Synthetic
tgggacattgtagacttggccagaccaatgcccaaatatttcccaagact

SEQ ID NO: 778 - DNA, 100 bp, Artificial Sequence
  Synthetic
ttctacaagatatgccatgggccttttcacaggggacacaggcttcttaaaacaacccggcttcctcaccctatgtcctttatttacaaagctgtgctcc

SEQ ID NO: 779 - DNA, 50 bp, Artificial Sequence
  Synthetic
ttaagaagcctgtgtcccctgtgaaaaggcccatggcatatcttgtagaa

SEQ ID NO: 780 - DNA, 50 bp, Artificial Sequence
  Synthetic
ggagcacagctttgtaaataaaggacatagggtgaggaagccgggttgtt

SEQ ID NO: 781 - DNA, 100 bp, Artificial Sequence
  Synthetic
ggaaaggagtcaccttaacaaagctgcagaaatcaaccttatgatttgccatctctcttgggtattttagatgctgggatcaccatatcgctgaagggtg

SEQ ID NO: 782 - DNA, 50 bp, Artificial Sequence
  Synthetic
ggcaaatcataaggttgatttctgcagctttgttaaggtgactcctttcc

SEQ ID NO: 783 - DNA, 50 bp, Artificial Sequence
  Synthetic
cacccttcagcgatatggtgatcccagcatctaaaatacccaagagagat

SEQ ID NO: 784 - DNA, 100 bp, Artificial Sequence
  Synthetic
ctcagcaaggcaagtgaggtgctgccgtcatccaggctggacagttcagtgatttgcctgaggccccacagcagagttcaactggagacagagaaaccag

SEQ ID NO: 785 - DNA, 40 bp, Artificial Sequence
  Synthetic
actgaactgtccagcctggatgacggcagcacctcacttg

SEQ ID NO: 786 - DNA, 38 bp, Artificial Sequence
  Synthetic
tctccagttgaactctgctgtggggcctcaggcaaatc

SEQ ID NO: 787 - DNA, 100 bp, Artificial Sequence
  Synthetic
ttcatatagtacagtccccacagggcctcatactcaatgcgactgccttgcccttgcctgacaaagagtttctctcatcatgtggctatgtgagcacaga

SEQ ID NO: 788 - DNA, 50 bp, Artificial Sequence
  Synthetic
caaggcagtcgcattgagtatgaggccctgtggggactgtactatatgaa

SEQ ID NO: 789 - DNA, 50 bp, Artificial Sequence
  Synthetic
tctgtgctcacatagccacatgatgagagaaactctttgtcaggcaaggg

SEQ ID NO: 790 - DNA, 100 bp, Artificial Sequence
  Synthetic
cagattttacaggctgaattattggcagtatatggagcagacccaggcacacaggattctagtgggaaaactcccgttgattatgcaaggcaaggagggc

SEQ ID NO: 791 - DNA, 50 bp, Artificial Sequence
  Synthetic
gtgcctgggtctgctccatatactgccaataattcagcctgtaaaatctg

SEQ ID NO: 792 - DNA, 50 bp, Artificial Sequence
  Synthetic
gccctccttgccttgcataatcaacgggagttttcccactagaatcctgt

SEQ ID NO: 793 - DNA, 100 bp, Artificial Sequence
  Synthetic
aaagcttggtgagaatgatgcctggaagaatggtgggggtaacaagagatgccactgggaaagaagtgtatcgtcttgctcttcaaaccagggagcaaca

SEQ ID NO: 794 - DNA, 50 bp, Artificial Sequence
  Synthetic
atctcttgttacccccaccattcttccaggcatcattctcaccaagcttt

SEQ ID NO: 795 - DNA, 50 bp, Artificial Sequence
  Synthetic
tgttgctccctggtttgaagagcaagacgatacacttctttcccagtggc

SEQ ID NO: 796 - DNA, 100 bp, Artificial Sequence
  Synthetic
atcccatcccaccttgaaaatcactgctctgaaccagtgttctccaccttgtcctccacagatctcataggaaatgttcaacaattctgtgaaaggtcac

SEQ ID NO: 797 - DNA, 50 bp, Artificial Sequence
  Synthetic
aaggtggagaacactggttcagagcagtgattttcaaggtgggatgggat

SEQ ID NO: 798 - DNA, 50 bp, Artificial Sequence
  Synthetic
gtgacctttcacagaattgttgaacatttcctatgagatctgtggaggac

SEQ ID NO: 799 - DNA, 100 bp, Artificial Sequence
  Synthetic
ttttcttacaatatcttcctgctataagagcattatgggcagacagcggcatacagaatgcctatgaccggcgtcgagaatttcaactgggtgaatctgt

SEQ ID NO: 800 - DNA, 50 bp, Artificial Sequence
  Synthetic
gccgctgtctgcccataatgctcttatagcaggaagatattgtaagaaaa

SEQ ID NO: 801 - DNA, 50 bp, Artificial Sequence
  Synthetic
acagattcacccagttgaaattctcgacgccggtcataggcattctgtat

SEQ ID NO: 802 - DNA, 100 bp, Artificial Sequence
  Synthetic
tgccatcagcaaggatatctcctccactttaatggacaggcctcatttttggcagctatgctgtttgagatgtagactgaatatccaaggttcctcccta

SEQ ID NO: 803 - DNA, 50 bp, Artificial Sequence
  Synthetic
aaaaatgaggcctgtccattaaagtggaggagatatccttgctgatggca

SEQ ID NO: 804 - DNA, 50 bp, Artificial Sequence
  Synthetic
tagggaggaaccttggatattcagtctacatctcaaacagcatagctgcc

SEQ ID NO: 805 - DNA, 100 bp, Artificial Sequence
  Synthetic
aacttttagagatatttcagccctttcctgtggcctggtcctatagccaaaatcacagatattcatgagtttctacttgagtgagaaaactgggtgaagg

SEQ ID NO: 806 - DNA, 50 bp, Artificial Sequence
  Synthetic
ttggctataggaccaggccacaggaaagggctgaaatatctctaaaagtt

SEQ ID NO: 807 - DNA, 50 bp, Artificial Sequence
  Synthetic
ccttcacccagttttctcactcaagtagaaactcatgaatatctgtgatt

SEQ ID NO: 808 - DNA, 100 bp, Artificial Sequence
  Synthetic
aatgaaagagggcatgtctaataacagcaccactagcatctcccaagccaggaaagctgtggagcagctaaagatggaagcctgtatggacagggtcaag

SEQ ID NO: 809 - DNA, 50 bp, Artificial Sequence
  Synthetic
tggcttgggagatgctagtggtgctgttattagacatgccctctttcatt

SEQ ID NO: 810 - DNA, 42 bp, Artificial Sequence
  Synthetic
tgtccatacaggcttccatctttagctgctccacagctttcc

SEQ ID NO: 811 - DNA, 100 bp, Artificial Sequence
  Synthetic
cattcagaagtgaagtctgctttgggaaagagggcctttggaaacttcttggaggttttcaggaaacttgcagcaaagccattcgggttggagtaattgg

SEQ ID NO: 812 - DNA, 50 bp, Artificial Sequence
  Synthetic
aagaagtttccaaaggccctctttcccaaagcagacttcacttctgaatg

SEQ ID NO: 813 - DNA, 50 bp, Artificial Sequence
  Synthetic
ccaattactccaacccgaatggctttgctgcaagtttcctgaaaacctcc

SEQ ID NO: 814 - DNA, 100 bp, Artificial Sequence
  Synthetic
ggccagcttcccttaactctgtagcctggcagtctgacccaaagttgccctcacccaaaggttctggctcttccctccctcacttttactttcccttccc

SEQ ID NO: 815 - DNA, 40 bp, Artificial Sequence
  Synthetic
gggcaactttgggtcagactgccaggctacagagttaagg

SEQ ID NO: 816 - DNA, 50 bp, Artificial Sequence
  Synthetic
gggaagggaaagtaaaagtgagggagggaagagccagaacctttgggtga

SEQ ID NO: 817 - DNA, 100 bp, Artificial Sequence
  Synthetic
tatgttggggtgggcttttccatcttgagcttggcagcctgtctagttgtggaagctgtggtgtggaaatcggtgaccaagaatcggacttcttatatgc

SEQ ID NO: 818 - DNA, 50 bp, Artificial Sequence
  Synthetic
acaactagacaggctgccaagctcaagatggaaaagcccaccccaacata

SEQ ID NO: 819 - DNA, 50 bp, Artificial Sequence
  Synthetic
gcatataagaagtccgattcttggtcaccgatttccacaccacagcttcc

SEQ ID NO: 820 - DNA, 100 bp, Artificial Sequence
  Synthetic
agtattctgctctgtgaccatcctcagcttccctgctattgctttggacaggtactactcagtcctctatccactggagaggaaaatatctgatgccaag

SEQ ID NO: 821 - DNA, 50 bp, Artificial Sequence
  Synthetic
tgtccaaagcaatagcagggaagctgaggatggtcacagagcagaatact

SEQ ID NO: 822 - DNA, 50 bp, Artificial Sequence
  Synthetic
cttggcatcagatattttcctctccagtggatagaggactgagtagtacc

SEQ ID NO: 823 - DNA, 100 bp, Artificial Sequence
  Synthetic
actggagaatcggagatgccttgtgtaggataactgcgctagtgttttacatcaacacatatgcaggtgtgaactttatgacctgcctgagtattgaccg

SEQ ID NO: 824 - DNA, 50 bp, Artificial Sequence
  Synthetic
gtaaaacactagcgcagttatcctacacaaggcatctccgattctccagt

SEQ ID NO: 825 - DNA, 50 bp, Artificial Sequence
  Synthetic
cggtcaatactcaggcaggtcataaagttcacacctgcatatgtgttgat

SEQ ID NO: 826 - DNA, 100 bp, Artificial Sequence
  Synthetic
ttccgctgggaaactctgctgacagtccgtttgaaagacatctgttccatgactaaagaaaaaacagctcgcctcattcccaatgccatccaagtttgca

SEQ ID NO: 827 - DNA, 50 bp, Artificial Sequence
  Synthetic
atggaacagatgtctttcaaacggactgtcagcagagtttcccagcggaa

SEQ ID NO: 828 - DNA, 50 bp, Artificial Sequence
  Synthetic
tgcaaacttggatggcattgggaatgaggcgagctgttttttctttagtc

SEQ ID NO: 829 - DNA, 100 bp, Artificial Sequence
  Synthetic
cctttgccacgtccccttagcttagtgatcaggtgtgagagtggccatttccttacctttgatccctgtaaagcagaaaggactcctttgacaggcgaca

SEQ ID NO: 830 - DNA, 50 bp, Artificial Sequence
  Synthetic
aaatggccactctcacacctgatcactaagctaaggggacgtggcaaagg

SEQ ID NO: 831 - DNA, 50 bp, Artificial Sequence
  Synthetic
tgtcgcctgtcaaaggagtcctttctgctttacagggatcaaaggtaagg

SEQ ID NO: 832 - DNA, 100 bp, Artificial Sequence
  Synthetic
ctttctaagccttgtgctaaaggcgtataacggtggtgcctatctacttaagggggcattctagtcttaacttaaaagttgtctaaactgtccctccctg

SEQ ID NO: 833 - DNA, 50 bp, Artificial Sequence
  Synthetic
taagtagataggcaccaccgttatacgcctttagcacaaggcttagaaag

SEQ ID NO: 834 - DNA, 50 bp, Artificial Sequence
  Synthetic
cagggagggacagtttagacaacttttaagttaagactagaatgccccct

SEQ ID NO: 835 - DNA, 100 bp, Artificial Sequence
  Synthetic
actgattatacctctagtatagatgtatggtctgctggctgtgtgttggctgagctgttactaggacaaccaatatttccaggggatagtggtgtggatc

SEQ ID NO: 836 - DNA, 50 bp, Artificial Sequence
  Synthetic
gccaacacacagccagcagaccatacatctatactagaggtataatcagt

SEQ ID NO: 837 - DNA, 50 bp, Artificial Sequence
  Synthetic
gatccacaccactatcccctggaaatattggttgtcctagtaacagctca

SEQ ID NO: 838 - DNA, 100 bp, Artificial Sequence
  Synthetic
gatgaagtcttcttcggaccctttggacataaagaaagatgtattgctgccagcttggaattaaataatccggttcccgaacagcctccgttgcccacat

SEQ ID NO: 839 - DNA, 50 bp, Artificial Sequence
  Synthetic
gcagcaatacatctttctttatgtccaaagggtccgaagaagacttcatc

SEQ ID NO: 840 - DNA, 50 bp, Artificial Sequence
  Synthetic
atgtgggcaacggaggctgttcgggaaccggattatttaattccaagctg

SEQ ID NO: 841 - DNA, 100 bp, Artificial Sequence
  Synthetic
gtcatgctcaaatcagctgtgctttttagccacaggaagatccaattccacatcttcactgaagactctctgaagcccgagtttgataagcagttacgcc

SEQ ID NO: 842 - DNA, 50 bp, Artificial Sequence
  Synthetic
tggaattggatcttcctgtggctaaaaagcacagctgatttgagcatgac

SEQ ID NO: 843 - DNA, 50 bp, Artificial Sequence
  Synthetic
ggcgtaactgcttatcaaactcgggcttcagagagtcttcagtgaagatg

SEQ ID NO: 844 - DNA, 100 bp, Artificial Sequence
  Synthetic
ctcttggcttggtctctaccctcactacctcagttctcaataacttagtgaatcactgccctcctcaaagccatttccactcagctctttccagagaatt

SEQ ID NO: 845 - DNA, 50 bp, Artificial Sequence
  Synthetic
cactaagttattgagaactgaggtagtgagggtagagaccaagccaagag

SEQ ID NO: 846 - DNA, 50 bp, Artificial Sequence
  Synthetic
aattctctggaaagagctgagtggaaatggctttgaggagggcagtgatt

SEQ ID NO: 847 - DNA, 100 bp, Artificial Sequence
  Synthetic
agtactttatttgagggacaacagacttcacttccctgaatgcctcccccatctccatcaggaaaaatacaccccatcgcccagcacccctgctgatacc

SEQ ID NO: 848 - DNA, 50 bp, Artificial Sequence
  Synthetic
gggggaggcattcagggaagtgaagtctgttgtccctcaaataaagtact

SEQ ID NO: 849 - DNA, 42 bp, Artificial Sequence
  Synthetic
caggggtgctgggcgatggggtgtatttttcctgatggagat

SEQ ID NO: 850 - DNA, 100 bp, Artificial Sequence
  Synthetic
ggctcctgggagcgtcaccagcgacatctcaccctcctcgacttccacagcaggatcatccaggtctcctgaatctgaaaagccaggcccgagccacggc

SEQ ID NO: 851 - DNA, 40 bp, Artificial Sequence
  Synthetic
ctgtggaagtcgaggagggtgagatgtcgctggtgacgct

SEQ ID NO: 852 - DNA, 38 bp, Artificial Sequence
  Synthetic
gcctggcttttcagattcaggagacctggatgatcctg

SEQ ID NO: 853 - DNA, 100 bp, Artificial Sequence
  Synthetic
atggcttgtgttacaagtagagagcagtggagagttgggctttgtaattctttcaagggtgattgtagttctggagtcctatctacctgggttcagatct

SEQ ID NO: 854 - DNA, 50 bp, Artificial Sequence
  Synthetic
gaattacaaagcccaactctccactgctctctacttgtaacacaagccat

SEQ ID NO: 855 - DNA, 50 bp, Artificial Sequence
  Synthetic
agatctgaacccaggtagataggactccagaactacaatcacccttgaaa

SEQ ID NO: 856 - DNA, 100 bp, Artificial Sequence
  Synthetic
ccgccccatttcccttccagcaaactcaactcggcaatccaagcacctagataccagcacaagtcggttaatccctgtctggactgagcctccgttggct

SEQ ID NO: 857 - DNA, 50 bp, Artificial Sequence
  Synthetic
ctaggtgcttggattgccgagttgagtttgctggaagggaaatggggcgg

SEQ ID NO: 858 - DNA, 47 bp, Artificial Sequence
  Synthetic
caacggaggctcagtccagacagggattaaccgacttgtgctggtat

SEQ ID NO: 859 - DNA, 100 bp, Artificial Sequence
  Synthetic
tgcagcagtcttccctcagtagtcagtttgaagcgggtatgcacaaagatagctggcttctgggtgacagttccttctttcttcgaacctggctcatgac

SEQ ID NO: 860 - DNA, 50 bp, Artificial Sequence
  Synthetic
atctttgtgcatacccgcttcaaactgactactgagggaagactgctgca

SEQ ID NO: 861 - DNA, 50 bp, Artificial Sequence
  Synthetic
gtcatgagccaggttcgaagaaagaaggaactgtcacccagaagccagct

SEQ ID NO: 862 - DNA, 100 bp, Artificial Sequence
  Synthetic
ccaggtcggaggcaatacattctcaaaaactgaaaccagcgccagcccacactgtcctgtgtacgtgccggatcccacatccaccatcaagccggggcct

SEQ ID NO: 863 - DNA, 50 bp, Artificial Sequence
  Synthetic
gtgggctggcgctggtttcagtttttgagaatgtattgcctccgacctgg

SEQ ID NO: 864 - DNA, 41 bp, Artificial Sequence
  Synthetic
cttgatggtggatgtgggatccggcacgtacacaggacagt

SEQ ID NO: 865 - DNA, 100 bp, Artificial Sequence
  Synthetic
caagccggtcatgtccaaagtaatggagatgttccagcctagtgcggtggtcttacagtgtggctcagactccctatctggggatcggttaggttgcttc

SEQ ID NO: 866 - DNA, 50 bp, Artificial Sequence
  Synthetic
ccaccgcactaggctggaacatctccattactttggacatgaccggcttg

SEQ ID NO: 867 - DNA, 45 bp, Artificial Sequence
  Synthetic
aacctaaccgatccccagatagggagtctgagccacactgtaaga

SEQ ID NO: 868 - DNA, 100 bp, Artificial Sequence
  Synthetic
aagcctattatctcaaaggtgatggagatgtatcaacctagtgctgtggtattacagtgtggtgcagactcattatctggtgatagactgggttgtttca

SEQ ID NO: 869 - DNA, 50 bp, Artificial Sequence
  Synthetic
accacagcactaggttgatacatctccatcacctttgagataataggctt

SEQ ID NO: 870 - DNA, 50 bp, Artificial Sequence
  Synthetic
tgaaacaacccagtctatcaccagataatgagtctgcaccacactgtaat

SEQ ID NO: 871 - DNA, 100 bp, Artificial Sequence
  Synthetic
tcatcaagagaatttggggcttccaagttgttcgggccaaggacctgagacctgaagggttgactttacccatttgggtgggagtgttgagcatctgtcc

SEQ ID NO: 872 - DNA, 50 bp, Artificial Sequence
  Synthetic
tctcaggtccttggcccgaacaacttggaagccccaaattctcttgatga

SEQ ID NO: 873 - DNA, 50 bp, Artificial Sequence
  Synthetic
ggacagatgctcaacactcccacccaaatgggtaaagtcaacccttcagg

SEQ ID NO: 874 - DNA, 100 bp, Artificial Sequence
  Synthetic
gaagtaacatctcatcctatgacggggaatatgctcagccttctactgagtcgccagttctgcatacatccaaccttccgtcctacacacccaccattaa

SEQ ID NO: 875 - DNA, 50 bp, Artificial Sequence
  Synthetic
ctcagtagaaggctgagcatattccccgtcataggatgagatgttacttc

SEQ ID NO: 876 - DNA, 50 bp, Artificial Sequence
  Synthetic
ttaatggtgggtgtgtaggacggaaggttggatgtatgcagaactggcga

SEQ ID NO: 877 - DNA, 100 bp, Artificial Sequence
  Synthetic
gatttgtataccggggctgccagtcagaaagattgtatggaagctacgtgtttggagatcgtaatgggaatttcctaactctccagcaaagtcctgtgac

SEQ ID NO: 878 - DNA, 50 bp, Artificial Sequence
  Synthetic
cacgtagcttccatacaatctttctgactggcagccccggtatacaaatc

SEQ ID NO: 879 - DNA, 50 bp, Artificial Sequence
  Synthetic
gtcacaggactttgctggagagttaggaaattcccattacgatctccaaa

SEQ ID NO: 880 - DNA, 100 bp, Artificial Sequence
  Synthetic
aacaatacgacagggccatggagagaaccgtcagagggagattgaaatccgatttgatcagcttcatcgggaatattgcctgagtcccaggaaccagcct

SEQ ID NO: 881 - DNA, 37 bp, Artificial Sequence
  Synthetic
ggatttcaatctccctctgacggttctctccatggcc

SEQ ID NO: 882 - DNA, 50 bp, Artificial Sequence
  Synthetic
aggctggttcctgggactcaggcaatattcccgatgaagctgatcaaatc

SEQ ID NO: 883 - DNA, 100 bp, Artificial Sequence
  Synthetic
ggaagagctcagatagaaaaggagggagttacactcaggctgcaagcagtgacagtgcccagggctctgatgtgtccctcacagcttgtaaagtgtgaga

SEQ ID NO: 884 - DNA, 50 bp, Artificial Sequence
  Synthetic
actgcttgcagcctgagtgtaactccctccttttctatctgagctcttcc

SEQ ID NO: 885 - DNA, 50 bp, Artificial Sequence
  Synthetic
tctcacactttacaagctgtgagggacacatcagagccctgggcactgtc

SEQ ID NO: 886 - DNA, 100 bp, Artificial Sequence
  Synthetic
tgaatgtgtctgcgtccctgttagcataatgtgaggaggtggagagacagcccacccttgtgtccactgtgacccctgttcccatgctgacctgtgtttc

SEQ ID NO: 887 - DNA, 48 bp, Artificial Sequence
  Synthetic
ctgtctctccacctcctcacattatgctaacagggacgcagacacatt

SEQ ID NO: 888 - DNA, 50 bp, Artificial Sequence
  Synthetic
gaaacacaggtcagcatgggaacaggggtcacagtggacacaagggtggg

SEQ ID NO: 889 - DNA, 100 bp, Artificial Sequence
  Synthetic
agctgggagccatcttcccagcccaccatccccatcatgggcatcgttgctggcctggctgtcctggttgtcctagctgtccttggagctgtggtcaccg

SEQ ID NO: 890 - DNA, 44 bp, Artificial Sequence
  Synthetic
gcaacgatgcccatgatggggatggtgggctgggaagatggctc

SEQ ID NO: 891 - DNA, 43 bp, Artificial Sequence
  Synthetic
cacagctccaaggacagctaggacaaccaggacagccaggcca

SEQ ID NO: 892 - DNA, 100 bp, Artificial Sequence
  Synthetic
ttatttgacaaagagttctgcgagtggatgatccagcaaatagggccaaaacttgatgggaaaatcccggtgtccagagggtttcctatcgctgaagtgt

SEQ ID NO: 893 - DNA, 50 bp, Artificial Sequence
  Synthetic
tttggccctatttgctggatcatccactcgcagaactctttgtcaaataa

SEQ ID NO: 894 - DNA, 50 bp, Artificial Sequence
  Synthetic
acacttcagcgataggaaaccctctggacaccgggattttcccatcaagt

SEQ ID NO: 895 - DNA, 100 bp, Artificial Sequence
  Synthetic
ggagagatctgaactccagctgccctacaaactccatctcagcttttcttctcacttcatgtgaaaactactccagtggctgactgaattgctgaccctt

SEQ ID NO: 896 - DNA, 50 bp, Artificial Sequence
  Synthetic
aagaaaagctgagatggagtttgtagggcagctggagttcagatctctcc

SEQ ID NO: 897 - DNA, 50 bp, Artificial Sequence
  Synthetic
aagggtcagcaattcagtcagccactggagtagttttcacatgaagtgag

SEQ ID NO: 898 - DNA, 100 bp, Artificial Sequence
  Synthetic
tccaaattggatactgctgccaagaagttgctctgaagtcagtttctatcattctgctctttgattcaaagcactgtttctctcactgggcctccaacca

SEQ ID NO: 899 - DNA, 50 bp, Artificial Sequence
  Synthetic
gatagaaactgacttcagagcaacttcttggcagcagtatccaatttgga

SEQ ID NO: 900 - DNA, 50 bp, Artificial Sequence
  Synthetic
tggttggaggcccagtgagagaaacagtgctttgaatcaaagagcagaat

SEQ ID NO: 901 - DNA, 100 bp, Artificial Sequence
  Synthetic
ggccaacatagctgtggacaaagccaacctggaaatcatgacaaagcgctccaactatactccgatcaccaatgtacctccagaggtaactgtgctcacg

SEQ ID NO: 902 - DNA, 50 bp, Artificial Sequence
  Synthetic
agcgctttgtcatgatttccaggttggctttgtccacagctatgttggcc

SEQ ID NO: 903 - DNA, 50 bp, Artificial Sequence
  Synthetic
cgtgagcacagttacctctggaggtacattggtgatcggagtatagttgg

SEQ ID NO: 904 - DNA, 100 bp, Artificial Sequence
  Synthetic
tgtcttaggggactctggcttctctttttgcaagggcctctgaatctgtctgtgtccctgttagcacaatgtgaggaggtagagaaacagtccacctctg

SEQ ID NO: 905 - DNA, 50 bp, Artificial Sequence
  Synthetic
gacagattcagaggcccttgcaaaaagagaagccagagtcccctaagaca

SEQ ID NO: 906 - DNA, 44 bp, Artificial Sequence
  Synthetic
tggactgtttctctacctcctcacattgtgctaacagggacaca

SEQ ID NO: 907 - DNA, 100 bp, Artificial Sequence
  Synthetic
ccattgggcgtcgcgtttctagagaagccaatcagtgtcgccgcagttcccaggttctaaagtcccacgcaccccgcgggactcatatttttcccagacg

SEQ ID NO: 908 - DNA, 50 bp, Artificial Sequence
  Synthetic
ggaactgcggcgacactgattggcttctctagaaacgcgacgcccaatgg

SEQ ID NO: 909 - DNA, 50 bp, Artificial Sequence
  Synthetic
cgtctgggaaaaatatgagtcccgcggggtgcgtgggactttagaacctg

SEQ ID NO: 910 - DNA, 100 bp, Artificial Sequence
  Synthetic
tggaagacaaagtgcgttccttaaagacagacattgaggagagcaaataccgacagcgccacctgaaggtggagttgaagagcttcctggaggtgctgga

SEQ ID NO: 911 - DNA, 50 bp, Artificial Sequence
  Synthetic
gtatttgctctcctcaatgtctgtctttaaggaacgcactttgtcttcca

SEQ ID NO: 912 - DNA, 38 bp, Artificial Sequence
  Synthetic
aggaagctcttcaactccaccttcaggtggcgctgtcg

SEQ ID NO: 913 - DNA, 100 bp, Artificial Sequence
  Synthetic
aacaataggaagctatgtgtatcttctgtgtaaagcagtggcttcactggaaaaatggtgtggctagcatttccctttgagtcatgatgacagatggtgt

SEQ ID NO: 914 - DNA, 50 bp, Artificial Sequence
  Synthetic
ccagtgaagccactgctttacacagaagatacacatagcttcctattgtt

SEQ ID NO: 915 - DNA, 50 bp, Artificial Sequence
  Synthetic
acaccatctgtcatcatgactcaaagggaaatgctagccacaccattttt

SEQ ID NO: 916 - DNA, 100 bp, Artificial Sequence
  Synthetic
ctgtttctaaggaaatgcatgtgtgccctgagccgtgatgatcctcccatccgtgttgtgagcacaggcatttgtgtctggtctgtcctccctgttgatt

SEQ ID NO: 917 - DNA, 50 bp, Artificial Sequence
  Synthetic
atgggaggatcatcacggctcagggcacacatgcatttccttagaaacag

SEQ ID NO: 918 - DNA, 50 bp, Artificial Sequence
  Synthetic
aatcaacagggaggacagaccagacacaaatgcctgtgctcacaacacgg

SEQ ID NO: 919 - DNA, 100 bp, Artificial Sequence
  Synthetic
ggtggcgcgtcagttgcttcagcgtcccggtgtggctgtgccgttggtcctgtgcggtcacttagccaagatgcctgaggaaacccagacccaagaccaa

SEQ ID NO: 920 - DNA, 43 bp, Artificial Sequence
  Synthetic
ggaccaacggcacagccacaccgggacgctgaagcaactgacg

SEQ ID NO: 921 - DNA, 39 bp, Artificial Sequence
  Synthetic
tctgggtttcctcaggcatcttggctaagtgaccgcaca

SEQ ID NO: 922 - DNA, 100 bp, Artificial Sequence
  Synthetic
tcagagctgacgatgaagttgatgtggatggtacagtagaagaggatctgggtaaaagtagagaaggatcaaggacggatgatgaagtagtacagagaga

SEQ ID NO: 923 - DNA, 46 bp, Artificial Sequence
  Synthetic
cagatcctcttctactgtaccatccacatcaacttcatcgtcagct

SEQ ID NO: 924 - DNA, 50 bp, Artificial Sequence
  Synthetic
tctctctgtactacttcatcatccgtccttgatccttctctacttttacc

SEQ ID NO: 925 - DNA, 100 bp, Artificial Sequence
  Synthetic
gaaagggcagtagatctctaatgtggaggtgggaacattattgtggtggaggcaattatgagggtagcatttctttcgagacaaaacacccgtctgggaa

SEQ ID NO: 926 - DNA, 45 bp, Artificial Sequence
  Synthetic
tccaccacaataatgttcccacctccacattagagatctactgcc

SEQ ID NO: 927 - DNA, 50 bp, Artificial Sequence
  Synthetic
ttcccagacgggtgttttgtctcgaaagaaatgctaccctcataattgcc

SEQ ID NO: 928 - DNA, 100 bp, Artificial Sequence
  Synthetic
ttcaagagagagacaggggttgatttgactaaagacaacatggcacttcagagggtacgggaagctgctgaaaaggctaaatgtgaactctcctcatctg

SEQ ID NO: 929 - DNA, 50 bp, Artificial Sequence
  Synthetic
tgaagtgccatgttgtctttagtcaaatcaacccctgtctctctcttgaa

SEQ ID NO: 930 - DNA, 50 bp, Artificial Sequence
  Synthetic
cagatgaggagagttcacatttagccttttcagcagcttcccgtaccctc

SEQ ID NO: 931 - DNA, 100 bp, Artificial Sequence
  Synthetic
cagatttagtgcaagtaaaatgttagagggtgcgggggtgaggactgaccacagattccctggatagtgtagtggtagatttctccacaggatagcgcaa

SEQ ID NO: 932 - DNA, 50 bp, Artificial Sequence
  Synthetic
ggtcagtcctcacccccgcaccctctaacattttacttgcactaaatctg

SEQ ID NO: 933 - DNA, 50 bp, Artificial Sequence
  Synthetic
ttgcgctatcctgtggagaaatctaccactacactatccagggaatctgt

SEQ ID NO: 934 - DNA, 100 bp, Artificial Sequence
  Synthetic
ttgcaatcccatctgataagattaaaaagttcctcacggagtcccatgaccgacaggccaaaggaaaagccatcaccaagaagaagtatattggtatccg

SEQ ID NO: 935 - DNA, 50 bp, Artificial Sequence
  Synthetic
gtcatgggactccgtgaggaactttttaatcttatcagatgggattgcaa

SEQ ID NO: 936 - DNA, 47 bp, Artificial Sequence
  Synthetic
ataccaatatacttcttcttggtgatggcttttcctttggcctgtcg

SEQ ID NO: 937 - DNA, 100 bp, Artificial Sequence
  Synthetic
caggttgctggggagtttccactcttctctggtgattgttccttccctcccttcctctcccaccatgcgatgagcatcctttcaggccagtgtctgcaga

SEQ ID NO: 938 - DNA, 50 bp, Artificial Sequence
  Synthetic
ggagggaaggaacaatcaccagagaagagtggaaactccccagcaacctg

SEQ ID NO: 939 - DNA, 46 bp, Artificial Sequence
  Synthetic
cagacactggcctgaaaggatgctcatcgcatggtgggagaggaag

SEQ ID NO: 940 - DNA, 100 bp, Artificial Sequence
  Synthetic
gaaatactgaaacttgctgcctattgggtatgctgaggcccacagacttacagaagaagtggccctccatagacatgtgtagcatcaaaacacaaaggcc

SEQ ID NO: 941 - DNA, 50 bp, Artificial Sequence
  Synthetic
taagtctgtgggcctcagcatacccaataggcagcaagtttcagtatttc

SEQ ID NO: 942 - DNA, 50 bp, Artificial Sequence
  Synthetic
ggcctttgtgttttgatgctacacatgtctatggagggccacttcttctg

SEQ ID NO: 943 - DNA, 100 bp, Artificial Sequence
  Synthetic
ctgccccagaaccgcaaggtgagcaaggtggagattctccagcacgtcatcgactacatcagggaccttcagttggagctgaactcggaatccgaagttg

SEQ ID NO: 944 - DNA, 44 bp, Artificial Sequence
  Synthetic
atgacgtgctggagaatctccaccttgctcaccttgcggttctg

SEQ ID NO: 945 - DNA, 50 bp, Artificial Sequence
  Synthetic
caacttcggattccgagttcagctccaactgaaggtccctgatgtagtcg

SEQ ID NO: 946 - DNA, 100 bp, Artificial Sequence
  Synthetic
cggatatcagcatcctgtccttgcaggcttctgaattcccttctgagttaatgtcaaatgacagcaaagcactgtgtggctgaataagcggtgttcatga

SEQ ID NO: 947 - DNA, 50 bp, Artificial Sequence
  Synthetic
taactcagaagggaattcagaagcctgcaaggacaggatgctgatatccg

SEQ ID NO: 948 - DNA, 50 bp, Artificial Sequence
  Synthetic
tcatgaacaccgcttattcagccacacagtgctttgctgtcatttgacat

SEQ ID NO: 949 - DNA, 100 bp, Artificial Sequence
  Synthetic
aggaagcctgtttgcaatttaagcgggctgtgaacgcccagggccggcgggggcagggccgaggcgggccattttgaataaagaggcgtgccttccaggc

SEQ ID NO: 950 - DNA, 43 bp, Artificial Sequence
  Synthetic
ccgccggccctgggcgttcacagcccgcttaaattgcaaacag

SEQ ID NO: 951 - DNA, 36 bp, Artificial Sequence
  Synthetic
cctctttattcaaaatggcccgcctcggccctgccc

SEQ ID NO: 952 - DNA, 100 bp, Artificial Sequence
  Synthetic
gggaagacgtccaagccttaaacatcagtgtgccgtatggtccaattcctgtggactttcagcggaaaatccgccagagctactttgcctctgtgtcata

SEQ ID NO: 953 - DNA, 50 bp, Artificial Sequence
  Synthetic
aggaattggaccatacggcacactgatgtttaaggcttggacgtcttccc

SEQ ID NO: 954 - DNA, 50 bp, Artificial Sequence
  Synthetic
tatgacacagaggcaaagtagctctggcggattttccgctgaaagtccac

SEQ ID NO: 955 - DNA, 100 bp, Artificial Sequence
  Synthetic
tcaactccgtctgtctactgtgtgagacttcggcggaccattaggaatgagatccgtgagatccttccatcttcttgaagtcgcctttagggtggctacg

SEQ ID NO: 956 - DNA, 50 bp, Artificial Sequence
  Synthetic
tcattcctaatggtccgccgaagtctcacacagtagacagacggagttga

SEQ ID NO: 957 - DNA, 50 bp, Artificial Sequence
  Synthetic
cgtagccaccctaaaggcgacttcaagaagatggaaggatctcacggatc

SEQ ID NO: 958 - DNA, 100 bp, Artificial Sequence
  Synthetic
tgccctctgcttgcgggctctgctctgatcacctttgatgaccccaaagtggctgagcaggtgctgcaacaaaaggagcacacgatcaacatggaggagt

SEQ ID NO: 959 - DNA, 46 bp, Artificial Sequence
  Synthetic
actttggggtcatcaaaggtgatcagagcagagcccgcaagcagag

SEQ ID NO: 960 - DNA, 39 bp, Artificial Sequence
  Synthetic
ttgatcgtgtgctccttttgttgcagcacctgctcagcc

SEQ ID NO: 961 - DNA, 100 bp, Artificial Sequence
  Synthetic
atctctgccatttatgttgtgtgacactatggggctagatggggcagaaggagcaggactgtgcatggatgacattccccacatcttaaaaggttgtatg

SEQ ID NO: 962 - DNA, 50 bp, Artificial Sequence
  Synthetic
cttctgccccatctagccccatagtgtcacacaacataaatggcagagat

SEQ ID NO: 963 - DNA, 50 bp, Artificial Sequence
  Synthetic
catacaaccttttaagatgtggggaatgtcatccatgcacagtcctgctc

SEQ ID NO: 964 - DNA, 100 bp, Artificial Sequence
  Synthetic
ggggtggaggcaggtaagaaaaagtgctcggagagctcggacagcggctccgggttctggaaggccctgaccttcatggccgtcggaggaggactcgcag

SEQ ID NO: 965 - DNA, 40 bp, Artificial Sequence
  Synthetic
gagccgctgtccgagctctccgagcactttttcttacctg

SEQ ID NO: 966 - DNA, 35 bp, Artificial Sequence
  Synthetic
cgacggccatgaaggtcagggccttccagaacccg

SEQ ID NO: 967 - DNA, 100 bp, Artificial Sequence
  Synthetic
gcttgggagaaccctctcccttctctgagaaagaaagatgtcgaatgggtattccacagacgagaatttccgctatctcatctcgtgcttcagggccagg

SEQ ID NO: 968 - DNA, 50 bp, Artificial Sequence
  Synthetic
acccattcgacatctttctttctcagagaagggagagggttctcccaagc

SEQ ID NO: 969 - DNA, 50 bp, Artificial Sequence
  Synthetic
cctggccctgaagcacgagatgagatagcggaaattctcgtctgtggaat

SEQ ID NO: 970 - DNA, 100 bp, Artificial Sequence
  Synthetic
gagaaaggcattagatctggaaagcttgagcctccttgggttcgtctacaaattggaaggaaatatgaatgaagccctggagtactatgagcgggccctg

SEQ ID NO: 971 - DNA, 50 bp, Artificial Sequence
  Synthetic
tgtagacgaacccaaggaggctcaagctttccagatctaatgcctttctc

SEQ ID NO: 972 - DNA, 50 bp, Artificial Sequence
  Synthetic
cagggcccgctcatagtactccagggcttcattcatatttccttccaatt

SEQ ID NO: 973 - DNA, 100 bp, Artificial Sequence
  Synthetic
tgcatcccatagaggttagtcctgcatagccagtaatgtgctaagttcatccaaaagctggcggaccaaagtctaaatagggctcagtatcccccatcgc

SEQ ID NO: 974 - DNA, 50 bp, Artificial Sequence
  Synthetic
atgaacttagcacattactggctatgcaggactaacctctatgggatgca

SEQ ID NO: 975 - DNA, 50 bp, Artificial Sequence
  Synthetic
gcgatgggggatactgagccctatttagactttggtccgccagcttttgg

SEQ ID NO: 976 - DNA, 100 bp, Artificial Sequence
  Synthetic
gaagaacaaatcagcctggtcaccagcttttcggaacagcagagacacagagggcagtcatgagtgaggtcaccaagaattccctggagaaaatccttcc

SEQ ID NO: 977 - DNA, 45 bp, Artificial Sequence
  Synthetic
ctgtgtctctgctgttccgaaaagctggtgaccaggctgatttgt

SEQ ID NO: 978 - DNA, 45 bp, Artificial Sequence
  Synthetic
gattttctccagggaattcttggtgacctcactcatgactgccct

SEQ ID NO: 979 - DNA, 100 bp, Artificial Sequence
  Synthetic
cctgttactggtattcggctctgtgacagtctaccatattatgttacagataatacaggaaaaacggggttactagtagccgcccatagcctgcaacctt

SEQ ID NO: 980 - DNA, 50 bp, Artificial Sequence
  Synthetic
tctgtaacataatatggtagactgtcacagagccgaataccagtaacagg

SEQ ID NO: 981 - DNA, 50 bp, Artificial Sequence
  Synthetic
aaggttgcaggctatgggcggctactagtaaccccgtttttcctgtatta

SEQ ID NO: 982 - DNA, 100 bp, Artificial Sequence
  Synthetic
aatgggttgcaaaatagaaatgagcttaatccaggccgcagagccagggaaggtgagtaactttaggagggtgctagactttagaagccagataggaaga

SEQ ID NO: 983 - DNA, 50 bp, Artificial Sequence
  Synthetic
tccctggctctgcggcctggattaagctcatttctattttgcaacccatt

SEQ ID NO: 984 - DNA, 50 bp, Artificial Sequence
  Synthetic
tcttcctatctggcttctaaagtctagcaccctcctaaagttactcacct

SEQ ID NO: 985 - DNA, 100 bp, Artificial Sequence
  Synthetic
agtggctgtgagacctcattgcgcattgtctactggagctttagtcttctgagacggaggaaaactgctgaatactctggattcatctatgtctacaatg

SEQ ID NO: 986 - DNA, 50 bp, Artificial Sequence
  Synthetic
agaagactaaagctccagtagacaatgcgcaatgaggtctcacagccact

SEQ ID NO: 987 - DNA, 50 bp, Artificial Sequence
  Synthetic
cattgtagacatagatgaatccagagtattcagcagttttcctccgtctc

SEQ ID NO: 988 - DNA, 100 bp, Artificial Sequence
  Synthetic
gtccaaattcttgggtggtgacatggaacacacccatttggtgaaaggcttggattttgctctgcttcaaaaggtacgagctgagattgccagcaaagag

SEQ ID NO: 989 - DNA, 50 bp, Artificial Sequence
  Synthetic
agcctttcaccaaatgggtgtgttccatgtcaccacccaagaatttggac

SEQ ID NO: 990 - DNA, 50 bp, Artificial Sequence
  Synthetic
ctctttgctggcaatctcagctcgtaccttttgaagcagagcaaaatcca

SEQ ID NO: 991 - DNA, 100 bp, Artificial Sequence
  Synthetic
aaggatcagctggacaacttgttgttaaaggagtccttgctggaggactttaagggttacctgggttgccaagccttgtctgagatgatccagttttacc

SEQ ID NO: 992 - DNA, 50 bp, Artificial Sequence
  Synthetic
aagtcctccagcaaggactcctttaacaacaagttgtccagctgatcctt

SEQ ID NO: 993 - DNA, 50 bp, Artificial Sequence
  Synthetic
ggtaaaactggatcatctcagacaaggcttggcaacccaggtaaccctta

SEQ ID NO: 994 - DNA, 100 bp, Artificial Sequence
  Synthetic
ctttctagatcaaaacatgctggcagttattgatgagctgatgcaggccctgaatttcaacagtgagactgtgccacaaaaatcctcccttgaagaaccg

SEQ ID NO: 995 - DNA, 50 bp, Artificial Sequence
  Synthetic
gggcctgcatcagctcatcaataactgccagcatgttttgatctagaaag

SEQ ID NO: 996 - DNA, 50 bp, Artificial Sequence
  Synthetic
cggttcttcaagggaggatttttgtggcacagtctcactgttgaaattca

SEQ ID NO: 997 - DNA, 100 bp, Artificial Sequence
  Synthetic
tctgcactggaagaagtacgacatctatgagaagcaaaccaaggaggaaaccgactctgtagtgctgatagaaaacctgaagaaagcctctcagtgatgg

SEQ ID NO: 998 - DNA, 50 bp, Artificial Sequence
  Synthetic
tttcctccttggtttgcttctcatagatgtcgtacttcttccagtgcaga

SEQ ID NO: 999 - DNA, 50 bp, Artificial Sequence
  Synthetic
ccatcactgagaggctttcttcaggttttctatcagcactacagagtcgg

SEQ ID NO: 1000 - DNA, 100 bp, Artificial Sequence
  Synthetic
ggcatctccaacatcatcatccaacgaagactcagctgcaaatggttctgctgaaacatctgccttggacacagggttctcgctcaacctttcagagctg

SEQ ID NO: 1001 - DNA, 50 bp, Artificial Sequence
  Synthetic
cagaaccatttgcagctgagtcttcgttggatgatgatgttggagatgcc

SEQ ID NO: 1002 - DNA, 50 bp, Artificial Sequence
  Synthetic
cagctctgaaaggttgagcgagaaccctgtgtccaaggcagatgtttcag

SEQ ID NO: 1003 - DNA, 100 bp, Artificial Sequence
  Synthetic
tcaattttgatgaatgtaagctgggtactccgggcagatgccagcatccgcttgttgaaggccaccaagatttgtgtgacgggcaaaagcaacttccagt

SEQ ID NO: 1004 - DNA, 50 bp, Artificial Sequence
  Synthetic
cggatgctggcatctgcccggagtacccagcttacattcatcaaaattga

SEQ ID NO: 1005 - DNA, 50 bp, Artificial Sequence
  Synthetic
actggaagttgcttttgcccgtcacacaaatcttggtggccttcaacaag

SEQ ID NO: 1006 - DNA, 100 bp, Artificial Sequence
  Synthetic
caagggcaccactaacaaggacaaagccaccatcattcaccttgattccgcacatgcccaacgatgacttctgtcctgggctaaccataaaggccatggg

SEQ ID NO: 1007 - DNA, 45 bp, Artificial Sequence
  Synthetic
cggaatcaaggtgaatgatggtggctttgtccttgttagtggtgc

SEQ ID NO: 1008 - DNA, 42 bp, Artificial Sequence
  Synthetic
ctttatggttagcccaggacagaagtcatcgttgggcatgtg

SEQ ID NO: 1009 - DNA, 100 bp, Artificial Sequence
  Synthetic
tgacaaacaaattcggtacatcctcgacggcatctcagccctgagaaaggagacatgtaacaagagtaacatgtgtgaaagcagcaaagaggcactggca

SEQ ID NO: 1010 - DNA, 50 bp, Artificial Sequence
  Synthetic
cctttctcagggctgagatgccgtcgaggatgtaccgaatttgtttgtca

SEQ ID NO: 1011 - DNA, 50 bp, Artificial Sequence
  Synthetic
tgccagtgcctctttgctgctttcacacatgttactcttgttacatgtct

SEQ ID NO: 1012 - DNA, 100 bp, Artificial Sequence
  Synthetic
ttggaagtgcagtcagcagatgctgttgtgaagctaatgtcacaattatgtgcaaaggtgtgcttcctgctgtatgtgagctgtaaaaatgttacgtgaa

SEQ ID NO: 1013 - DNA, 50 bp, Artificial Sequence
  Synthetic
cataattgtgacattagcttcacaacagcatctgctgactgcacttccaa

SEQ ID NO: 1014 - DNA, 50 bp, Artificial Sequence
  Synthetic
ttcacgtaacatttttacagctcacatacagcaggaagcacacctttgca

SEQ ID NO: 1015 - DNA, 100 bp, Artificial Sequence
  Synthetic
ataatggccacatggatcgaacactcatgatgtgccaagtgctgtgctaagtgctttacgaacattcgtcatatcaggatgacctcgagagctgaggctc

SEQ ID NO: 1016 - DNA, 50 bp, Artificial Sequence
  Synthetic
ttagcacagcacttggcacatcatgagtgttcgatccatgtggccattat

SEQ ID NO: 1017 - DNA, 50 bp, Artificial Sequence
  Synthetic
gagcctcagctctcgaggtcatcctgatatgacgaatgttcgtaaagcac

SEQ ID NO: 1018 - DNA, 100 bp, Artificial Sequence
  Synthetic
cacagccgtggaaggactggcccttggcagctctgcatcatcgtcgtcagagccaccgcagattatcatcaaccctgcccgacagaagatggtccagaag

SEQ ID NO: 1019 - DNA, 36 bp, Artificial Sequence
  Synthetic
ctgacgacgatgatgcagagctgccaagggccagtc

SEQ ID NO: 1020 - DNA, 41 bp, Artificial Sequence
  Synthetic
catcttctgtcgggcagggttgatgataatctgcggtggct

SEQ ID NO: 1021 - DNA, 100 bp, Artificial Sequence
  Synthetic
gtgttggccgaggtcctcacgggcatccctgcaatggataacaaccgaagcccggtttacctgaaggacttactcctcagtgatattccaagcagcaccg

SEQ ID NO: 1022 - DNA, 43 bp, Artificial Sequence
  Synthetic
cttcggttgttatccattgcagggatgcccgtgaggacctcgg

SEQ ID NO: 1023 - DNA, 50 bp, Artificial Sequence
  Synthetic
cggtgctgcttggaatatcactgaggagtaagtccttcaggtaaaccggg

SEQ ID NO: 1024 - DNA, 100 bp, Artificial Sequence
  Synthetic
aggtaaatatagatccttcttcagaagctccagggcattcttgcaggagcaggccagtggagagcagctgttcctccaaattttcctgggatgaatatga

SEQ ID NO: 1025 - DNA, 50 bp, Artificial Sequence
  Synthetic
gctcctgcaagaatgccctggagcttctgaagaaggatctatatttacct

SEQ ID NO: 1026 - DNA, 50 bp, Artificial Sequence
  Synthetic
tcatattcatcccaggaaaatttggaggaacagctgctctccactggcct

SEQ ID NO: 1027 - DNA, 100 bp, Artificial Sequence
  Synthetic
gaattctccttgtaagccttgaagaagtatgtgagagggccacattggctaaaacctaaaggtggcctctaggagatgagacctaccttccagttgtcag

SEQ ID NO: 1028 - DNA, 50 bp, Artificial Sequence
  Synthetic
agccaatgtggccctctcacatacttcttcaaggcttacaaggagaattc

SEQ ID NO: 1029 - DNA, 50 bp, Artificial Sequence
  Synthetic
ctgacaactggaaggtaggtctcatctcctagaggccacctttaggtttt

SEQ ID NO: 1030 - DNA, 100 bp, Artificial Sequence
  Synthetic
ctgtgcgagtgtaccggatgcttccacctctcaccaagaaccagagaaaagaaagaaagtcgaagtccagccgagatgctaagagcaaggccaagaggaa

SEQ ID NO: 1031 - DNA, 50 bp, Artificial Sequence
  Synthetic
ttttctctggttcttggtgagaggtggaagcatccggtacactcgcacag

SEQ ID NO: 1032 - DNA, 50 bp, Artificial Sequence
  Synthetic
ttcctcttggccttgctcttagcatctcggctggacttcgactttctttc

SEQ ID NO: 1033 - DNA, 100 bp, Artificial Sequence
  Synthetic
gggcactgtttaaaggaaagttccgagaaggcatcgacaagccggaccctcccacctggaagacgcgcctgcggtgcgctttgaacaagagcaatgactt

SEQ ID NO: 1034 - DNA, 50 bp, Artificial Sequence
  Synthetic
agggtccggcttgtcgatgccttctcggaactttcctttaaacagtgccc

SEQ ID NO: 1035 - DNA, 38 bp, Artificial Sequence
  Synthetic
ttgttcaaagcgcaccgcaggcgcgtcttccaggtggg

SEQ ID NO: 1036 - DNA, 100 bp, Artificial Sequence
  Synthetic
cccggcagcacggtcctgctggtggtggacaaatgcgacgaacctctgagcatcctggtgaggaataacaagggccgcagcagcacctacgaggtacggc

SEQ ID NO: 1037 - DNA, 38 bp, Artificial Sequence
  Synthetic
ctcagaggttcgtcgcatttgtccaccaccagcaggac

SEQ ID NO: 1038 - DNA, 35 bp, Artificial Sequence
  Synthetic
tgctgctgcggcccttgttattcctcaccaggatg

SEQ ID NO: 1039 - DNA, 100 bp, Artificial Sequence
  Synthetic
ggcaaaacatcagtgtctgtgggtagttggaatcttcagttcctgtgagcgtcggcgtcttctgggcctgtggagtttcttggacaggggccgcggggct

SEQ ID NO: 1040 - DNA, 50 bp, Artificial Sequence
  Synthetic
gctcacaggaactgaagattccaactacccacagacactgatgttttgcc

SEQ ID NO: 1041 - DNA, 40 bp, Artificial Sequence
  Synthetic
cccctgtccaagaaactccacaggcccagaagacgccgac

SEQ ID NO: 1042 - DNA, 100 bp, Artificial Sequence
  Synthetic
catgtctccaacctcctttgtatatggcgagtccgtggacgcagccaacttcattcagctggatgacctggagtgtcactttcagcccatcaatatcacc

SEQ ID NO: 1043 - DNA, 50 bp, Artificial Sequence
  Synthetic
agttggctgcgtccacggactcgccatatacaaaggaggttggagacatg

SEQ ID NO: 1044 - DNA, 50 bp, Artificial Sequence
  Synthetic
ggtgatattgatgggctgaaagtgacactccaggtcatccagctgaatga

SEQ ID NO: 1045 - DNA, 100 bp, Artificial Sequence
  Synthetic
tttcttccgattccaaactgggagcacaaggagaaccctgagactgaagaagatgttgggccagttgttcagcacatctatgagctgagaaacaatggtc

SEQ ID NO: 1046 - DNA, 50 bp, Artificial Sequence
  Synthetic
tcttcagtctcagggttctccttgtgctcccagtttggaatcggaagaaa

SEQ ID NO: 1047 - DNA, 50 bp, Artificial Sequence
  Synthetic
gaccattgtttctcagctcatagatgtgctgaacaactggcccaacatct

SEQ ID NO: 1048 - DNA, 100 bp, Artificial Sequence
  Synthetic
cccctcagcctgttggcttctgttcaccagctgcaagggtttacatacacggccaccgccatccaaaatgtcgtgcaccgattgttccatgcctcatatg

SEQ ID NO: 1049 - DNA, 49 bp, Artificial Sequence
  Synthetic
gtgtatgtaaacccttgcagctggtgaacagaagccaacaggctgaggg

SEQ ID NO: 1050 - DNA, 50 bp, Artificial Sequence
  Synthetic
catatgaggcatggaacaatcggtgcacgacattttggatggcggtggcc

SEQ ID NO: 1051 - DNA, 100 bp, Artificial Sequence
  Synthetic
catcgacctgtactatctgatggacctctcctactccatgcttgatgacctcaggaatgtcaagaagctaggtggcgacctgctccgggccctcaacgag

SEQ ID NO: 1052 - DNA, 41 bp, Artificial Sequence
  Synthetic
ggtcatcaagcatggagtaggagaggtccatcagatagtac

SEQ ID NO: 1053 - DNA, 37 bp, Artificial Sequence
  Synthetic
cggagcaggtcgccacctagcttcttgacattcctga

SEQ ID NO: 1054 - DNA, 100 bp, Artificial Sequence
  Synthetic
gtggcctcctggcatcatttgttattgcctctgaaacaagccttactgcctggagggcttagattcctgcttctccaatgtagtgtgggtatcttgtagg

SEQ ID NO: 1055 - DNA, 50 bp, Artificial Sequence
  Synthetic
ggcagtaaggcttgtttcagaggcaataacaaatgatgccaggaggccac

SEQ ID NO: 1056 - DNA, 50 bp, Artificial Sequence
  Synthetic
cctacaagatacccacactacattggagaagcaggaatctaagccctcca

SEQ ID NO: 1057 - DNA, 100 bp, Artificial Sequence
  Synthetic
gagaacaccaagctctggtatgctccaaatcgcaccatcaccgttgatgacaagatgtccctccggctccactaccggatgaggttctatttcaccaatt

SEQ ID NO: 1058 - DNA, 50 bp, Artificial Sequence
  Synthetic
tcatcaacggtgatggtgcgatttggagcataccagagcttggtgttctc

SEQ ID NO: 1059 - DNA, 50 bp, Artificial Sequence
  Synthetic
aattggtgaaatagaacctcatccggtagtggagccggagggacatcttg

SEQ ID NO: 1060 - DNA, 100 bp, Artificial Sequence
  Synthetic
ctcctcccgcgacggcaaatgttctgaaaaagactctgcatgggaatggcctgccttacgatgacagaaatggagggaacatccacctcttctatatatc

SEQ ID NO: 1061 - DNA, 50 bp, Artificial Sequence
  Synthetic
gccattcccatgcagagtctttttcagaacatttgccgtcgcgggaggag

SEQ ID NO: 1062 - DNA, 50 bp, Artificial Sequence
  Synthetic
gatatatagaagaggtggatgttccctccatttctgtcatcgtaaggcag

SEQ ID NO: 1063 - DNA, 100 bp, Artificial Sequence
  Synthetic
gtgctgctgaaggtcatggatgccaagcacaagaactgcatggagtcattcctggaagcagcgagcttgatgagccaagtgtcgtaccggcatctcgtgc

SEQ ID NO: 1064 - DNA, 47 bp, Artificial Sequence
  Synthetic
aatgactccatgcagttcttgtgcttggcatccatgaccttcagcag

SEQ ID NO: 1065 - DNA, 39 bp, Artificial Sequence
  Synthetic
cggtacgacacttggctcatcaagctcgctgcttccagg

SEQ ID NO: 1066 - DNA, 100 bp, Artificial Sequence
  Synthetic
ggaggtgctttggggctaccgttttgctcccatagtatccaagacaaaggaagggaaataccgagtggatttccataactttagcaagacagtggaagtg

SEQ ID NO: 1067 - DNA, 50 bp, Artificial Sequence
  Synthetic
cctttgtcttggatactatgggagcaaaacggtagccccaaagcacctcc

SEQ ID NO: 1068 - DNA, 50 bp, Artificial Sequence
  Synthetic
cacttccactgtcttgctaaagttatggaaatccactcggtatttccctt

SEQ ID NO: 1069 - DNA, 100 bp, Artificial Sequence
  Synthetic
ccaggggctctaccgcctgggcaacttcctcttcatcctgctcggcgtgtgctgcatttactcgctcttcaacgtcatctccatcctcatcaagcaggtg

SEQ ID NO: 1070 - DNA, 40 bp, Artificial Sequence
  Synthetic
acacgccgagcaggatgaagaggaagttgcccaggcggta

SEQ ID NO: 1071 - DNA, 50 bp, Artificial Sequence
  Synthetic
cacctgcttgatgaggatggagatgacgttgaagagcgagtaaatgcagc

SEQ ID NO: 1072 - DNA, 100 bp, Artificial Sequence
  Synthetic
tattgagtacctcaagcgggaatgggagacgcttcataacttccccaaagtgtccatattgcctggtacgccattaagtcgggctgatttaagggctgtc

SEQ ID NO: 1073 - DNA, 50 bp, Artificial Sequence
  Synthetic
ctttggggaagttatgaagcgtctcccattcccgcttgaggtactcaata

SEQ ID NO: 1074 - DNA, 50 bp, Artificial Sequence
  Synthetic
gacagcccttaaatcagcccgacttaatggcgtaccaggcaatatggaca

SEQ ID NO: 1075 - DNA, 100 bp, Artificial Sequence
  Synthetic
gtatgagactgtctcgggagactggcttctgttactggagacatttgctattttcatctttggagccgagtttgctttgaggatctgggctgctggatgt

SEQ ID NO: 1076 - DNA, 50 bp, Artificial Sequence
  Synthetic
tagcaaatgtctccagtaacagaagccagtctcccgagacagtctcatac

SEQ ID NO: 1077 - DNA, 50 bp, Artificial Sequence
  Synthetic
acatccagcagcccagatcctcaaagcaaactcggctccaaagatgaaaa

SEQ ID NO: 1078 - DNA, 100 bp, Artificial Sequence
  Synthetic
tatgccaatgggcagaacttcacggatgcagacagcccttgccatgcctgccactgtcaggatggaactgtgacatgctccttggttgactgccctccca

SEQ ID NO: 1079 - DNA, 38 bp, Artificial Sequence
  Synthetic
caggcatggcaagggctgtctgcatccgtgaagttctg

SEQ ID NO: 1080 - DNA, 42 bp, Artificial Sequence
  Synthetic
cagtcaaccaaggagcatgtcacagttccatcctgacagtgg

SEQ ID NO: 1081 - DNA, 100 bp, Artificial Sequence
  Synthetic
attctccacccaatgccttccttgaagaggatggaacaagtctccttatttcctgtgcaaagtgctgcgtacgggttcatgcaagttgttatggtattcc

SEQ ID NO: 1082 - DNA, 50 bp, Artificial Sequence
  Synthetic
aataaggagacttgttccatcctcttcaaggaaggcattgggtggagaat

SEQ ID NO: 1083 - DNA, 50 bp, Artificial Sequence
  Synthetic
ggaataccataacaacttgcatgaacccgtacgcagcactttgcacagga

SEQ ID NO: 1084 - DNA, 100 bp, Artificial Sequence
  Synthetic
caatcacacaattaaagcggggcatgtactgacgattatggaagtgagtgaaagagacacaggaaattacactgtcatccttaccaatcccatttcaaag

SEQ ID NO: 1085 - DNA, 50 bp, Artificial Sequence
  Synthetic
cactcacttccataatcgtcagtacatgccccgctttaattgtgtgattg

SEQ ID NO: 1086 - DNA, 50 bp, Artificial Sequence
  Synthetic
ctttgaaatgggattggtaaggatgacagtgtaatttcctgtgtctcttt

SEQ ID NO: 1087 - DNA, 100 bp, Artificial Sequence
  Synthetic
ccaggtgggagtggaattcaggtttggggctcgttggtatccatgcaaaatatgacaaaggcctgttcaagagggcattttcaattctgtaggctcagca

SEQ ID NO: 1088 - DNA, 50 bp, Artificial Sequence
  Synthetic
ttttgcatggataccaacgagccccaaacctgaattccactcccacctgg

SEQ ID NO: 1089 - DNA, 50 bp, Artificial Sequence
  Synthetic
tgctgagcctacagaattgaaaatgccctcttgaacaggcctttgtcata

SEQ ID NO: 1090 - DNA, 100 bp, Artificial Sequence
  Synthetic
aggaaagcctgtctttggttaggctcgtgtacttctgcaggaaaaaaaaaaaaggatgtgtcattggtcatgatatttgaaaaggggaggaggccgaagt

SEQ ID NO: 1091 - DNA, 50 bp, Artificial Sequence
  Synthetic
tttttttttcctgcagaagtacacgagcctaaccaaagacaggctttcct

SEQ ID NO: 1092 - DNA, 50 bp, Artificial Sequence
  Synthetic
acttcggcctcctccccttttcaaatatcatgaccaatgacacatccttt

SEQ ID NO: 1093 - DNA, 100 bp, Artificial Sequence
  Synthetic
cagaccatttaatttggcagagcggaaagctagcgcccattcaatagtagaatgtgatcctgtacgaaaagaagttagtgtacgaactggaggattggct

SEQ ID NO: 1094 - DNA, 50 bp, Artificial Sequence
  Synthetic
ctactattgaatgggcgctagctttccgctctgccaaattaaatggtctg

SEQ ID NO: 1095 - DNA, 50 bp, Artificial Sequence
  Synthetic
agccaatcctccagttcgtacactaacttcttttcgtacaggatcacatt

SEQ ID NO: 1096 - DNA, 100 bp, Artificial Sequence
  Synthetic
tgatcgagcaatccagtcacttactattcagactgcatgtgcttttgagcagctagtagtgctaatgaaacactggctgagtgatttactgccttgtacc

SEQ ID NO: 1097 - DNA, 50 bp, Artificial Sequence
  Synthetic
gctcaaaagcacatgcagtctgaatagtaagtgactggattgctcgatca

SEQ ID NO: 1098 - DNA, 50 bp, Artificial Sequence
  Synthetic
ggtacaaggcagtaaatcactcagccagtgtttcattagcactactagct

SEQ ID NO: 1099 - DNA, 100 bp, Artificial Sequence
  Synthetic
aaccacctcaagtttctgatgaacattctgcatccatatacaccctgtgacagtcagcagtctgctattaagtggcctacttcaaggctttgaatcaact

SEQ ID NO: 1100 - DNA, 50 bp, Artificial Sequence
  Synthetic
tcacagggtgtatatggatgcagaatgttcatcagaaacttgaggtggtt

SEQ ID NO: 1101 - DNA, 50 bp, Artificial Sequence
  Synthetic
agttgattcaaagccttgaagtaggccacttaatagcagactgctgactg

SEQ ID NO: 1102 - DNA, 100 bp, Artificial Sequence
  Synthetic
catagacttgcaatgttgaaaactcgtcgctcctacctggagaaaaggagggaggaggaattgaagcaatttgatgagaatactaattggctccatcgtg

SEQ ID NO: 1103 - DNA, 50 bp, Artificial Sequence
  Synthetic
ctccttttctccaggtaggagcgacgagttttcaacattgcaagtctatg

SEQ ID NO: 1104 - DNA, 50 bp, Artificial Sequence
  Synthetic
cacgatggagccaattagtattctcatcaaattgcttcaattcctcctcc

SEQ ID NO: 1105 - DNA, 100 bp, Artificial Sequence
  Synthetic
tccaagcagccaacctcctgacgcccgacatgatcacagagtttgagaccctacagcagctggtgcaagaggaaaaaattgagcctggggcagaggcctt

SEQ ID NO: 1106 - DNA, 41 bp, Artificial Sequence
  Synthetic
ggtctcaaactctgtgatcatgtcgggcgtcaggaggttgg

SEQ ID NO: 1107 - DNA, 38 bp, Artificial Sequence
  Synthetic
ccaggctcaattttttcctcttgcaccagctgctgtag

SEQ ID NO: 1108 - DNA, 100 bp, Artificial Sequence
  Synthetic
gcaggcttccctatctgattggccgaacgaacgcagcgcgtaatttaaaatattgtatctgtaacaaagctgcacctcgtgggcggagttgtgctctgcg

SEQ ID NO: 1109 - DNA, 50 bp, Artificial Sequence
  Synthetic
ttttaaattacgcgctgcgttcgttcggccaatcagatagggaagcctgc

SEQ ID NO: 1110 - DNA, 50 bp, Artificial Sequence
  Synthetic
cgcagagcacaactccgcccacgaggtgcagctttgttacagatacaata

SEQ ID NO: 1111 - DNA, 100 bp, Artificial Sequence
  Synthetic
tgtgtggatgatttctcgaaagccatgccagaagcagtcttccaggtcatcttgtagaactccagctttgttgaaaatcacggacctcagctacatcata

SEQ ID NO: 1112 - DNA, 50 bp, Artificial Sequence
  Synthetic
atgacctggaagactgcttctggcatggctttcgagaaatcatccacaca

SEQ ID NO: 1113 - DNA, 50 bp, Artificial Sequence
  Synthetic
tatgatgtagctgaggtccgtgattttcaacaaagctggagttctacaag

SEQ ID NO: 1114 - DNA, 100 bp, Artificial Sequence
  Synthetic
cctgctctaacggggcgctgattccaggcaatttatccaaggaagaggaggaactgtcttcccagatgtccagctttaacgaagccatgactcagatcag

SEQ ID NO: 1115 - DNA, 50 bp, Artificial Sequence
  Synthetic
ctcctcttccttggataaattgcctggaatcagcgccccgttagagcagg

SEQ ID NO: 1116 - DNA, 50 bp, Artificial Sequence
  Synthetic
ctgatctgagtcatggcttcgttaaagctggacatctgggaagacagttc

SEQ ID NO: 1117 - DNA, 100 bp, Artificial Sequence
  Synthetic
ggagcaaagcatggacatcgaggatctaaaatattgttcagagcattctgtgaatgagcatgaggatggtgatggtgatgatgatgagggggatgacgag

SEQ ID NO: 1118 - DNA, 50 bp, Artificial Sequence
  Synthetic
cagaatgctctgaacaatattttagatcctcgatgtccatgctttgctcc

SEQ ID NO: 1119 - DNA, 40 bp, Artificial Sequence
  Synthetic
ccctcatcatcatcaccatcaccatcctcatgctcattca

SEQ ID NO: 1120 - DNA, 100 bp, Artificial Sequence
  Synthetic
ggacttcagcattttggggaaaagatccagtttgctccacaagaaaataggaatgagagaggaaatgtcattaggatgccaggaggcttttgaaatcttc

SEQ ID NO: 1121 - DNA, 50 bp, Artificial Sequence
  Synthetic
ctattttcttgtggagcaaactggatcttttccccaaaatgctgaagtcc

SEQ ID NO: 1122 - DNA, 50 bp, Artificial Sequence
  Synthetic
gaagatttcaaaagcctcctggcatcctaatgacatttcctctctcattc

SEQ ID NO: 1123 - DNA, 100 bp, Artificial Sequence
  Synthetic
gtggggagagattgctaaaaaggagtttccttctagggtgatgaaaatgttctggaactacttattggggatgattgcacaacatggtgaaggtactcaa

SEQ ID NO: 1124 - DNA, 50 bp, Artificial Sequence
  Synthetic
acattttcatcaccctagaaggaaactcctttttagcaatctctccccac

SEQ ID NO: 1125 - DNA, 50 bp, Artificial Sequence
  Synthetic
ttgagtaccttcaccatgttgtgcaatcatccccaataagtagttccaga

SEQ ID NO: 1126 - DNA, 100 bp, Artificial Sequence
  Synthetic
tgatgatccagaagtattagcagatacctgctgggctatttcctaccttactgatggtccaaatgaacgaattggcatggtggtgaaaacaggagttgtg

SEQ ID NO: 1127 - DNA, 50 bp, Artificial Sequence
  Synthetic
taaggtaggaaatagcccagcaggtatctgctaatacttctggatcatca

SEQ ID NO: 1128 - DNA, 50 bp, Artificial Sequence
  Synthetic
cacaactcctgttttcaccaccatgccaattcgttcatttggaccatcag

SEQ ID NO: 1129 - DNA, 100 bp, Artificial Sequence
  Synthetic
catggactgtgtccccacggtcatccagtgttgtcatgcattggttagtcaaaatggggagggactagggcagtttggatagctcaacaagatacaatct

SEQ ID NO: 1130 - DNA, 50 bp, Artificial Sequence
  Synthetic
gactaaccaatgcatgacaacactggatgaccgtggggacacagtccatg

SEQ ID NO: 1131 - DNA, 50 bp, Artificial Sequence
  Synthetic
agattgtatcttgttgagctatccaaactgccctagtccctccccatttt

SEQ ID NO: 1132 - DNA, 100 bp, Artificial Sequence
  Synthetic
taagtgggccaaaatagcagcctatggtcatgaagtggggaagcgtccttggattacaggagatgagagtattgtaggccttatgaaggacattgtagga

SEQ ID NO: 1133 - DNA, 50 bp, Artificial Sequence
  Synthetic
aaggacgcttccccacttcatgaccataggctgctattttggcccactta

SEQ ID NO: 1134 - DNA, 47 bp, Artificial Sequence
  Synthetic
tcctacaatgtccttcataaggcctacaatactctcatctcctgtaa

SEQ ID NO: 1135 - DNA, 100 bp, Artificial Sequence
  Synthetic
ttgccaggagctgctaccaagatcctgttactttacagcttgcctgtgtttgtgatcctggatacattggttccagatgtgacgactgtgcctcaggata

SEQ ID NO: 1136 - DNA, 50 bp, Artificial Sequence
  Synthetic
aacacaggcaagctgtaaagtaacaggatcttggtagcagctcctggcaa

SEQ ID NO: 1137 - DNA, 50 bp, Artificial Sequence
  Synthetic
tatcctgaggcacagtcgtcacatctggaaccaatgtatccaggatcaca

SEQ ID NO: 1138 - DNA, 100 bp, Artificial Sequence
  Synthetic
ggtctctgccttatgggtatgggtgtctataaaatccgcctaaggtgtcaatcatctggataccagagaatctaattgttgcccggggggaatgaaaata

SEQ ID NO: 1139 - DNA, 50 bp, Artificial Sequence
  Synthetic
tgacaccttaggcggattttatagacacccatacccataaggcagagacc

SEQ ID NO: 1140 - DNA, 50 bp, Artificial Sequence
  Synthetic
tattttcattccccccgggcaacaattagattctctggtatccagatgat

SEQ ID NO: 1141 - DNA, 100 bp, Artificial Sequence
  Synthetic
aatgcctatgccttcctgacactctacaacctcacacaggacatgaagtacctgtatagggcctgtaagtttgctgaatggtgcttagagtatggagaac

SEQ ID NO: 1142 - DNA, 45 bp, Artificial Sequence
  Synthetic
tacttcatgtcctgtgtgaggttgtagagtgtcaggaaggcatag

SEQ ID NO: 1143 - DNA, 50 bp, Artificial Sequence
  Synthetic
gttctccatactctaagcaccattcagcaaacttacaggccctatacagg

SEQ ID NO: 1144 - DNA, 100 bp, Artificial Sequence
  Synthetic
tgtgtaatagaataaaggcctgcgtgtgtctgtgttgagcgtgcgtctgtgtgtgcctgtgtgcgagtctgagtcagagatttggagatgtctctgtgtg

SEQ ID NO: 1145 - DNA, 50 bp, Artificial Sequence
  Synthetic
acagacgcacgctcaacacagacacacgcaggcctttattctattacaca

SEQ ID NO: 1146 - DNA, 50 bp, Artificial Sequence
  Synthetic
cacacagagacatctccaaatctctgactcagactcgcacacaggcacac

SEQ ID NO: 1147 - DNA, 100 bp, Artificial Sequence
  Synthetic
tgcagagctgattaaacagtgttgtgactgtctcatgggaagagctggggcccagagggaccttgagtcagaaatgttgccagaaaaagtatctcctcca

SEQ ID NO: 1148 - DNA, 43 bp, Artificial Sequence
  Synthetic
ccccagctcttcccatgagacagtcacaacactgtttaatcag

SEQ ID NO: 1149 - DNA, 45 bp, Artificial Sequence
  Synthetic
gagatactttttctggcaacatttctgactcaaggtccctctggg

SEQ ID NO: 1150 - DNA, 100 bp, Artificial Sequence
  Synthetic
cagaatggaatctcagaccttgtgaaggtgactctgacttctgaggaagaggcccgtttgaagaagagtgcagatacactttgggggatccaaaaggagc

SEQ ID NO: 1151 - DNA, 50 bp, Artificial Sequence
  Synthetic
tcttcctcagaagtcagagtcaccttcacaaggtctgagattccattctg

SEQ ID NO: 1152 - DNA, 50 bp, Artificial Sequence
  Synthetic
gctccttttggatcccccaaagtgtatctgcactcttcttcaaacgggcc

SEQ ID NO: 1153 - DNA, 100 bp, Artificial Sequence
  Synthetic
tgtgcttggctgtatgattttccctgatggctgggactcagatgaagtaaaacggatgtgtggagaaaagacagacaagtacactcttggggcttgctca

SEQ ID NO: 1154 - DNA, 50 bp, Artificial Sequence
  Synthetic
ttacttcatctgagtcccagccatcagggaaaatcatacagccaagcaca

SEQ ID NO: 1155 - DNA, 40 bp, Artificial Sequence
  Synthetic
ccaagagtgtacttgtctgtcttttctccacacatccgtt

SEQ ID NO: 1156 - DNA, 100 bp, Artificial Sequence
  Synthetic
tagaggctttgagcaactaactaaccacattttaggatctcgcctggaaacagaggtaaaaaaaagaagtgtgcgcccggctaatgcagcggtgtggacc

SEQ ID NO: 1157 - DNA, 50 bp, Artificial Sequence
  Synthetic
tttccaggcgagatcctaaaatgtggttagttagttgctcaaagcctcta

SEQ ID NO: 1158 - DNA, 45 bp, Artificial Sequence
  Synthetic
acaccgctgcattagccgggcgcacacttcttttttttacctctg

SEQ ID NO: 1159 - DNA, 100 bp, Artificial Sequence
  Synthetic
aactacatcctgaactcgacgtcctgaggtataatacaacagagcactttttgaggcaattgaaaaaccaacctacactcttcggtgcttagagagatct

SEQ ID NO: 1160 - DNA, 50 bp, Artificial Sequence
  Synthetic
aaagtgctctgttgtattatacctcaggacgtcgagttcaggatgtagtt

SEQ ID NO: 1161 - DNA, 50 bp, Artificial Sequence
  Synthetic
agatctctctaagcaccgaagagtgtaggttggtttttcaattgcctcaa

SEQ ID NO: 1162 - DNA, 100 bp, Artificial Sequence
  Synthetic
aaggcaagtctcaggaacccatgcaggtacatcgcttgcacctgtttttagcttatttaatgacgggcttttgggaagagctgcccgcatactgagagac

SEQ ID NO: 1163 - DNA, 50 bp, Artificial Sequence
  Synthetic
taaaaacaggtgcaagcgatgtacctgcatgggttcctgagacttgcctt

SEQ ID NO: 1164 - DNA, 49 bp, Artificial Sequence
  Synthetic
tctctcagtatgcgggcagctcttcccaaaagcccgtcattaaataagc

SEQ ID NO: 1165 - DNA, 100 bp, Artificial Sequence
  Synthetic
cttttgttgttggggtctgtgactgcggatataactgacggcaacagtgaacatctcaagcgggagcattcgctcattaagccctaccaaggggtcggtt

SEQ ID NO: 1166 - DNA, 50 bp, Artificial Sequence
  Synthetic
tcactgttgccgtcagttatatccgcagtcacagaccccaacaacaaaag

SEQ ID NO: 1167 - DNA, 42 bp, Artificial Sequence
  Synthetic
ccttggtagggcttaatgagcgaatgctcccgcttgagatgt

SEQ ID NO: 1168 - DNA, 100 bp, Artificial Sequence
  Synthetic
aagcatttctgtgtaggtgacagatacctcctcatcaactctgacatagtgtgcgaacaggacatctacgagtggactaagatcaatgggatgatatagg

SEQ ID NO: 1169 - DNA, 50 bp, Artificial Sequence
  Synthetic
actatgtcagagttgatgaggaggtatctgtcacctacacagaaatgctt

SEQ ID NO: 1170 - DNA, 50 bp, Artificial Sequence
  Synthetic
cctatatcatcccattgatcttagtccactcgtagatgtcctgttcgcac

SEQ ID NO: 1171 - DNA, 100 bp, Artificial Sequence
  Synthetic
ccattatgtctccatatcagactctgttgggtacaagtgacacagaaagtcatctcaaactagctgaaacacaaaagcgcaggaaggcggaagggaaggc

SEQ ID NO: 1172 - DNA, 50 bp, Artificial Sequence
  Synthetic
actttctgtgtcacttgtacccaacagagtctgatatggagacataatgg

SEQ ID NO: 1173 - DNA, 39 bp, Artificial Sequence
  Synthetic
cgccttcctgcgcttttgtgtttcagctagtttgagatg

SEQ ID NO: 1174 - DNA, 100 bp, Artificial Sequence
  Synthetic
ggtttgccatcctcctctagttaaaagtaagggggaaaagagtaaacgcgcgactccagcgcgcggctacctacgcttggtgcttgctttctccagccat

SEQ ID NO: 1175 - DNA, 50 bp, Artificial Sequence
  Synthetic
cgcgtttactcttttcccccttacttttaactagaggaggatggcaaacc

SEQ ID NO: 1176 - DNA, 45 bp, Artificial Sequence
  Synthetic
tggagaaagcaagcaccaagcgtaggtagccgcgcgctggagtcg

SEQ ID NO: 1177 - DNA, 100 bp, Artificial Sequence
  Synthetic
tgccaccggcaactacgatatcaagtggacaatgccacattgtgttctgactttgaagctgattggtttggctgttgactactttgacggagggaaagat

SEQ ID NO: 1178 - DNA, 50 bp, Artificial Sequence
  Synthetic
tcagaacacaatgtggcattgtccacttgatatcgtagttgccggtggca

SEQ ID NO: 1179 - DNA, 50 bp, Artificial Sequence
  Synthetic
atctttccctccgtcaaagtagtcaacagccaaaccaatcagcttcaaag

SEQ ID NO: 1180 - DNA, 100 bp, Artificial Sequence
  Synthetic
tccatcagaaaggctaataaggccctctggctctctattgcattcattgtactgtttgcagctttgatgagcttcctcacaggccaattattccagaagt

SEQ ID NO: 1181 - DNA, 50 bp, Artificial Sequence
  Synthetic
acaatgaatgcaatagagagccagagggccttattagcctttctgatgga

SEQ ID NO: 1182 - DNA, 50 bp, Artificial Sequence
  Synthetic
acttctggaataattggcctgtgaggaagctcatcaaagctgcaaacagt

SEQ ID NO: 1183 - DNA, 100 bp, Artificial Sequence
  Synthetic
gccaggaggccttccgcctctgtggctccgccatcccacctgccttcatctctgcccgcgaccatgtctggattttcttccactcagacgcctccagctc

SEQ ID NO: 1184 - DNA, 40 bp, Artificial Sequence
  Synthetic
gatgaaggcaggtgggatggcggagccacagaggcggaag

SEQ ID NO: 1185 - DNA, 47 bp, Artificial Sequence
  Synthetic
ctggaggcgtctgagtggaagaaaatccagacatggtcgcgggcaga

SEQ ID NO: 1186 - DNA, 100 bp, Artificial Sequence
  Synthetic
aaaatgtgagtgtggtacagaggaaataggtaagacccccttatctagccctctcggcagcagcgggggggtgttacaaaggactagctgttcaaatatc

SEQ ID NO: 1187 - DNA, 50 bp, Artificial Sequence
  Synthetic
ggctagataagggggtcttacctatttcctctgtaccacactcacatttt

SEQ ID NO: 1188 - DNA, 50 bp, Artificial Sequence
  Synthetic
gatatttgaacagctagtcctttgtaacacccccccgctgctgccgagag

SEQ ID NO: 1189 - DNA, 100 bp, Artificial Sequence
  Synthetic
ctgccttctctggctttcctgctatacacatattcacatggcgctcaagaagttaggctcatggcaacgtgtgtctttctctggacaactggcccagttt

SEQ ID NO: 1190 - DNA, 50 bp, Artificial Sequence
  Synthetic
tcttgagcgccatgtgaatatgtgtatagcaggaaagccagagaaggcag

SEQ ID NO: 1191 - DNA, 50 bp, Artificial Sequence
  Synthetic
aaactgggccagttgtccagagaaagacacacgttgccatgagcctaact

SEQ ID NO: 1192 - DNA, 100 bp, Artificial Sequence
  Synthetic
gtgtgccaagactcgaaattcggtccgcacacaacaggacactttctctgccagctttcaagatgtgatgcagaggccaagtctgacgaattgaagtttc

SEQ ID NO: 1193 - DNA, 50 bp, Artificial Sequence
  Synthetic
cagagaaagtgtcctgttgtgtgcggaccgaatttcgagtcttggcacac

SEQ ID NO: 1194 - DNA, 50 bp, Artificial Sequence
  Synthetic
gaaacttcaattcgtcagacttggcctctgcatcacatcttgaaagctgg

SEQ ID NO: 1195 - DNA, 100 bp, Artificial Sequence
  Synthetic
catctctcccagcttagcctctggctgtaagcttcggtcattgcctccatgcccttgcttggctcaagcaccaccaatcgctttaatgcttcagccaccg

SEQ ID NO: 1196 - DNA, 48 bp, Artificial Sequence
  Synthetic
atggaggcaatgaccgaagcttacagccagaggctaagctgggagaga

SEQ ID NO: 1197 - DNA, 50 bp, Artificial Sequence
  Synthetic
cggtggctgaagcattaaagcgattggtggtgcttgagccaagcaagggc

SEQ ID NO: 1198 - DNA, 100 bp, Artificial Sequence
  Synthetic
aaactgtgtgaacggtgaactttggagtgaagatcaatcttgcacttggtgaagagtgcacattggacctcaaggcgaaagccagtggtttgcttggata

SEQ ID NO: 1199 - DNA, 50 bp, Artificial Sequence
  Synthetic
accaagtgcaagattgatcttcactccaaagttcaccgttcacacagttt

SEQ ID NO: 1200 - DNA, 45 bp, Artificial Sequence
  Synthetic
aagcaaaccactggctttcgccttgaggtccaatgtgcactcttc

SEQ ID NO: 1201 - DNA, 100 bp, Artificial Sequence
  Synthetic
atgatggcaaaaccccaggagcagttaatgcctgtcatttatcctgcagtgctttgctgcaagataacatcgctgatgctgtagcttgtgcaaagagggt

SEQ ID NO: 1202 - DNA, 50 bp, Artificial Sequence
  Synthetic
actgcaggataaatgacaggcattaactgctcctggggttttgccatcat

SEQ ID NO: 1203 - DNA, 50 bp, Artificial Sequence
  Synthetic
accctctttgcacaagctacagcatcagcgatgttatcttgcagcaaagc

SEQ ID NO: 1204 - DNA, 100 bp, Artificial Sequence
  Synthetic
ctatagaggtgacatcacattgctagaggtagatgctatagtcaatgccgcaaatgccagtcttcttggaggaggaggtgtggatggctgtattcataga

SEQ ID NO: 1205 - DNA, 50 bp, Artificial Sequence
  Synthetic
cggcattgactatagcatctacctctagcaatgtgatgtcacctctatag

SEQ ID NO: 1206 - DNA, 50 bp, Artificial Sequence
  Synthetic
tctatgaatacagccatccacacctcctcctccaagaagactggcatttg

SEQ ID NO: 1207 - DNA, 100 bp, Artificial Sequence
  Synthetic
gccttcgcgtccgggttgggagcttgctgtgtctaacctccaactgctgtgctgtctgctagggtcacctcctgtttgtgaaaggggaccttcttgttcg

SEQ ID NO: 1208 - DNA, 48 bp, Artificial Sequence
  Synthetic
acagcagttggaggttagacacagcaagctcccaacccggacgcgaag

SEQ ID NO: 1209 - DNA, 50 bp, Artificial Sequence
  Synthetic
cgaacaagaaggtcccctttcacaaacaggaggtgaccctagcagacagc

SEQ ID NO: 1210 - DNA, 100 bp, Artificial Sequence
  Synthetic
agtgttgatggcgtctctgaatccaagttgcaaatctgtgttgaaccaacttcccaaaagctgatgccaggcagcacattggttttacagtgtgttgctg

SEQ ID NO: 1211 - DNA, 50 bp, Artificial Sequence
  Synthetic
gttggttcaacacagatttgcaacttggattcagagacgccatcaacact

SEQ ID NO: 1212 - DNA, 50 bp, Artificial Sequence
  Synthetic
cagcaacacactgtaaaaccaatgtgctgcctggcatcagcttttgggaa

SEQ ID NO: 1213 - DNA, 100 bp, Artificial Sequence
  Synthetic
tggaagccatcaacaatttgcccagtaacatgccactgccttcagcttctcctcttcaccaacttgacctgaaaccttctttgcccttgcagaacagtgg

SEQ ID NO: 1214 - DNA, 50 bp, Artificial Sequence
  Synthetic
agaagctgaaggcagtggcatgttactgggcaaattgttgatggcttcca

SEQ ID NO: 1215 - DNA, 50 bp, Artificial Sequence
  Synthetic
ccactgttctgcaagggcaaagaaggtttcaggtcaagttggtgaagagg

SEQ ID NO: 1216 - DNA, 100 bp, Artificial Sequence
  Synthetic
acttcagagacttctccagccagttgtagacaccatcctagtcaaatgtgcagatgccaatagccgcacaagtcagctgtccatatcaacactgttggaa

SEQ ID NO: 1217 - DNA, 50 bp, Artificial Sequence
  Synthetic
cacatttgactaggatggtgtctacaactggctggagaagtctctgaagt

SEQ ID NO: 1218 - DNA, 50 bp, Artificial Sequence
  Synthetic
ttccaacagtgttgatatggacagctgacttgtgcggctattggcatctg

SEQ ID NO: 1219 - DNA, 100 bp, Artificial Sequence
  Synthetic
ctggctacttcaatcttgttcggggaccaccaacgcttgaatatggctgaaggatgccatgtttgctctaaattaagacagcattgatctcctggaggct

SEQ ID NO: 1220 - DNA, 50 bp, Artificial Sequence
  Synthetic
tcagccatattcaagcgttggtggtccccgaacaagattgaagtagccag

SEQ ID NO: 1221 - DNA, 50 bp, Artificial Sequence
  Synthetic
agcctccaggagatcaatgctgtcttaatttagagcaaacatggcatcct

SEQ ID NO: 1222 - DNA, 100 bp, Artificial Sequence
  Synthetic
gatgcctacatcagtagcatatattcgatccaatcagacaatgggctggggagagaaggccatagagatccgatctgtggaaactggtcacttggatggt

SEQ ID NO: 1223 - DNA, 50 bp, Artificial Sequence
  Synthetic
cccagcccattgtctgattggatcgaatatatgctactgatgtaggcatc

SEQ ID NO: 1224 - DNA, 44 bp, Artificial Sequence
  Synthetic
caagtgaccagtttccacagatcggatctctatggccttctctc

SEQ ID NO: 1225 - DNA, 100 bp, Artificial Sequence
  Synthetic
gtattcatacagcactacttacttagagatgctactgtcagtgtcctcagggctctaccaagacataatgcactggggtaccacatggtccatttcatgt

SEQ ID NO: 1226 - DNA, 50 bp, Artificial Sequence
  Synthetic
ctgaggacactgacagtagcatctctaagtaagtagtgctgtatgaatac

SEQ ID NO: 1227 - DNA, 50 bp, Artificial Sequence
  Synthetic
acatgaaatggaccatgtggtaccccagtgcattatgtcttggtagagcc

SEQ ID NO: 1228 - DNA, 100 bp, Artificial Sequence
  Synthetic
gcgaagaaagatcatgacaggcagttttgagttcccagaggaagagtggagtcagatctcagagatggccaaagatgttgtgaggaagctcctgaaggtc

SEQ ID NO: 1229 - DNA, 50 bp, Artificial Sequence
  Synthetic
tccactcttcctctgggaactcaaaactgcctgtcatgatctttcttcgc

SEQ ID NO: 1230 - DNA, 50 bp, Artificial Sequence
  Synthetic
gaccttcaggagcttcctcacaacatctttggccatctctgagatctgac

SEQ ID NO: 1231 - DNA, 100 bp, Artificial Sequence
  Synthetic
ccaccacccccacccccctccctccggtgtgtgtgccgctgccgctgttgccgccgccgctgctgctgctcgccccgtcgttacaccaacccgaggctct

SEQ ID NO: 1232 - DNA, 35 bp, Artificial Sequence
  Synthetic
caacagcggcagcggcacacacaccggagggaggg

SEQ ID NO: 1233 - DNA, 35 bp, Artificial Sequence
  Synthetic
tgtaacgacggggcgagcagcagcagcggcggcgg

SEQ ID NO: 1234 - DNA, 100 bp, Artificial Sequence
  Synthetic
cagcttcccaagttaggttagtgatgtgaaatgctcctgtccctggccctacctccttccctgtccccacccctgcataaggcagttgttggttttcttc

SEQ ID NO: 1235 - DNA, 50 bp, Artificial Sequence
  Synthetic
agggccagggacaggagcatttcacatcactaacctaacttgggaagctg

SEQ ID NO: 1236 - DNA, 50 bp, Artificial Sequence
  Synthetic
gaagaaaaccaacaactgccttatgcaggggtggggacagggaaggaggt

SEQ ID NO: 1237 - DNA, 100 bp, Artificial Sequence
  Synthetic
atgctcctcacaggaaaagctgcatcagttgcctttccagcctacagctgatgagctgcactttttgacgaagcatttcagcacagagagcgtaccagat

SEQ ID NO: 1238 - DNA, 50 bp, Artificial Sequence
  Synthetic
cagctgtaggctggaaaggcaactgatgcagcttttcctgtgaggagcat

SEQ ID NO: 1239 - DNA, 50 bp, Artificial Sequence
  Synthetic
atctggtacgctctctgtgctgaaatgcttcgtcaaaaagtgcagctcat

SEQ ID NO: 1240 - DNA, 100 bp, Artificial Sequence
  Synthetic
aaggagtggagtcaacatatcaatggagcaagtcacagtcgtcgatgccagcttcttcttgaaatctacccagaatggaatcctgacaatgatacaggac

SEQ ID NO: 1241 - DNA, 47 bp, Artificial Sequence
  Synthetic
tggcatcgacgactgtgacttgctccattgatatgttgactccactc

SEQ ID NO: 1242 - DNA, 50 bp, Artificial Sequence
  Synthetic
gtcctgtatcattgtcaggattccattctgggtagatttcaagaagaagc

SEQ ID NO: 1243 - DNA, 100 bp, Artificial Sequence
  Synthetic
gctgtaacttcctagagttgcaccctagcaacctagccagaaaagcaagtggcaagaggattatggctaacaagaataaatacatgggaagagtgctccc

SEQ ID NO: 1244 - DNA, 50 bp, Artificial Sequence
  Synthetic
acttgcttttctggctaggttgctagggtgcaactctaggaagttacagc

SEQ ID NO: 1245 - DNA, 50 bp, Artificial Sequence
  Synthetic
gggagcactcttcccatgtatttattcttgttagccataatcctcttgcc

SEQ ID NO: 1246 - DNA, 100 bp, Artificial Sequence
  Synthetic
aataacttcttgacgcgggaaaatggcgagcccgacgcatttgatgagctctttgatgccgacggcgacggtgaatcttatacagaagaggctgatgatg

SEQ ID NO: 1247 - DNA, 50 bp, Artificial Sequence
  Synthetic
agctcatcaaatgcgtcgggctcgccattttcccgcgtcaagaagttatt

SEQ ID NO: 1248 - DNA, 50 bp, Artificial Sequence
  Synthetic
catcatcagcctcttctgtataagattcaccgtcgccgtcggcatcaaag

SEQ ID NO: 1249 - DNA, 100 bp, Artificial Sequence
  Synthetic
tgggaaatatccctcgtagtatcacggtgctggtagaaggagagaacacaaggattgcccagcctggagaccacgtcagcgtcactggtattttcttgcc

SEQ ID NO: 1250 - DNA, 45 bp, Artificial Sequence
  Synthetic
tgtgttctctccttctaccagcaccgtgatactacgagggatatt

SEQ ID NO: 1251 - DNA, 48 bp, Artificial Sequence
  Synthetic
caagaaaataccagtgacgctgacgtggtctccaggctgggcaatcct

SEQ ID NO: 1252 - DNA, 100 bp, Artificial Sequence
  Synthetic
caatagccacttcacacatggagagatgcaagaccagtccatttggggaaatccttcggatggtgaactcattagaacccaacctcagcgcttgcctcag

SEQ ID NO: 1253 - DNA, 50 bp, Artificial Sequence
  Synthetic
ttccccaaatggactggtcttgcatctctccatgtgtgaagtggctattg

SEQ ID NO: 1254 - DNA, 50 bp, Artificial Sequence
  Synthetic
ctgaggcaagcgctgaggttgggttctaatgagttcaccatccgaaggat

SEQ ID NO: 1255 - DNA, 100 bp, Artificial Sequence
  Synthetic
gatctacaggaacttggtagtagtcaatcagcaggaatcatcggactcaggtacatctgtgagtgagaacaggtgtcaccttgaaggtgggagtgatcaa

SEQ ID NO: 1256 - DNA, 50 bp, Artificial Sequence
  Synthetic
ctgagtccgatgattcctgctgattgactactaccaagttcctgtagatc

SEQ ID NO: 1257 - DNA, 50 bp, Artificial Sequence
  Synthetic
ttgatcactcccaccttcaaggtgacacctgttctcactcacagatgtac

SEQ ID NO: 1258 - DNA, 100 bp, Artificial Sequence
  Synthetic
ctcatctcattgtttcagcggaggccaaatctgaagtcctttccagggagtggctctgttcatcttattcgccagccaaagtaggaacagcgtaagagga

SEQ ID NO: 1259 - DNA, 50 bp, Artificial Sequence
  Synthetic
ctccctggaaaggacttcagatttggcctccgctgaaacaatgagatgag

SEQ ID NO: 1260 - DNA, 50 bp, Artificial Sequence
  Synthetic
tcctcttacgctgttcctactttggctggcgaataagatgaacagagcca

SEQ ID NO: 1261 - DNA, 100 bp, Artificial Sequence
  Synthetic
cgaacaggaccagattttgtttggagcctcagcatgccggggcccagatgatggagcataacgggtcccagccaattgtgatgatcctttttgctcattt

SEQ ID NO: 1262 - DNA, 45 bp, Artificial Sequence
  Synthetic
catctgggccccggcatgctgaggctccaaacaaaatctggtcct

SEQ ID NO: 1263 - DNA, 50 bp, Artificial Sequence
  Synthetic
aaatgagcaaaaaggatcatcacaattggctgggacccgttatgctccat

SEQ ID NO: 1264 - DNA, 100 bp, Artificial Sequence
  Synthetic
gttgggatctcatcagcagtgccatttctcatcttggtggccctcatggagagtaacctcatcattacatatgcggtagctgtggcagctggcatcagtg

SEQ ID NO: 1265 - DNA, 50 bp, Artificial Sequence
  Synthetic
tccatgagggccaccaagatgagaaatggcactgctgatgagatcccaac

SEQ ID NO: 1266 - DNA, 50 bp, Artificial Sequence
  Synthetic
cactgatgccagctgccacagctaccgcatatgtaatgatgaggttactc

SEQ ID NO: 1267 - DNA, 100 bp, Artificial Sequence
  Synthetic
caggctatactgactggaagcctggtagctttgtgcaactttcaggccactaaactggccaagacacaactggtaggcacaccaaatttctggcaggagc

SEQ ID NO: 1268 - DNA, 40 bp, Artificial Sequence
  Synthetic
gtggcctgaaagttgcacaaagctaccaggcttccagtca

SEQ ID NO: 1269 - DNA, 40 bp, Artificial Sequence
  Synthetic
gaaatttggtgtgcctaccagttgtgtcttggccagttta

SEQ ID NO: 1270 - DNA, 100 bp, Artificial Sequence
  Synthetic
tggacctaactgcaccagtagcttttctgagaatacttgctgaaaaggaagttttctggaatggtatttgctaagtggaagccagaagaggaggaaaatg

SEQ ID NO: 1271 - DNA, 50 bp, Artificial Sequence
  Synthetic
ttccttttcagcaagtattctcagaaaagctactggtgcagttaggtcca

SEQ ID NO: 1272 - DNA, 50 bp, Artificial Sequence
  Synthetic
cattttcctcctcttctggcttccacttagcaaataccattccagaaaac

SEQ ID NO: 1273 - DNA, 100 bp, Artificial Sequence
  Synthetic
agcagatgtagagggagaactcttagcgtgcaggaatctaatgccatcagcaggcaaagccatgcacacgcctaaaccatcagtaggtgaagagaaagac

SEQ ID NO: 1274 - DNA, 48 bp, Artificial Sequence
  Synthetic
ctgatggcattagattcctgcacgctaagagttctccctctacatctg

SEQ ID NO: 1275 - DNA, 50 bp, Artificial Sequence
  Synthetic
gtctttctcttcacctactgatggtttaggcgtgtgcatggctttgcctg

SEQ ID NO: 1276 - DNA, 100 bp, Artificial Sequence
  Synthetic
ccaacattaattttcctaatctcaagcaagactacccagactggtcaagccgttgcaaacaaatcatgaagctctggagaaaggttccagcagctgacaa

SEQ ID NO: 1277 - DNA, 50 bp, Artificial Sequence
  Synthetic
gcttgaccagtctgggtagtcttgcttgagattaggaaaattaatgttgg

SEQ ID NO: 1278 - DNA, 46 bp, Artificial Sequence
  Synthetic
cagctgctggaacctttctccagagcttcatgatttgtttgcaacg

SEQ ID NO: 1279 - DNA, 100 bp, Artificial Sequence
  Synthetic
ctgagcggcaaagcccgaatggtctctagcgaccggcccgtgtcactggaggacgaggtctcccatagtatgaaggagatgattggaggctgttgcgttt

SEQ ID NO: 1280 - DNA, 35 bp, Artificial Sequence
  Synthetic
tccagtgacacgggccggtcgctagagaccattcg

SEQ ID NO: 1281 - DNA, 50 bp, Artificial Sequence
  Synthetic
aaacgcaacagcctccaatcatctccttcatactatgggagacctcgtcc

SEQ ID NO: 1282 - DNA, 100 bp, Artificial Sequence
  Synthetic
ggattgtaggtgcaagctgtccagagaaaagagtccttgttccagccctattctgccactcctgacagggtgaccttgggtatttgcaatattcctttgg

SEQ ID NO: 1283 - DNA, 50 bp, Artificial Sequence
  Synthetic
tagggctggaacaaggactcttttctctggacagcttgcacctacaatcc

SEQ ID NO: 1284 - DNA, 50 bp, Artificial Sequence
  Synthetic
ccaaaggaatattgcaaatacccaaggtcaccctgtcaggagtggcagaa

SEQ ID NO: 1285 - DNA, 100 bp, Artificial Sequence
  Synthetic
caacttacatcgtgttgcggctcatgaactcggccattctcttggactctcccattctactgatatcggggctttgatgtaccctagctacaccttcagt

SEQ ID NO: 1286 - DNA, 50 bp, Artificial Sequence
  Synthetic
agagtccaagagaatggccgagttcatgagccgcaacacgatgtaagttg

SEQ ID NO: 1287 - DNA, 50 bp, Artificial Sequence
  Synthetic
actgaaggtgtagctagggtacatcaaagccccgatatcagtagaatggg

SEQ ID NO: 1288 - DNA, 100 bp, Artificial Sequence
  Synthetic
cccggaggggcctggcagccgtgccttcagctctacagctaatcagcattctcactcctacctggtaatttaagattccagagagtggctcctcccggtg

SEQ ID NO: 1289 - DNA, 40 bp, Artificial Sequence
  Synthetic
aatgctgattagctgtagagctgaaggcacggctgccagg

SEQ ID NO: 1290 - DNA, 50 bp, Artificial Sequence
  Synthetic
caccgggaggagccactctctggaatcttaaattaccaggtaggagtgag

SEQ ID NO: 1291 - DNA, 100 bp, Artificial Sequence
  Synthetic
cactactgtgcctttgagtccggtggacgatgcctgcaacgtgaacatcttcgacgccatcgcggagattgggaaccagctgtatttgttcaaggatggg

SEQ ID NO: 1292 - DNA, 45 bp, Artificial Sequence
  Synthetic
agatgttcacgttgcaggcatcgtccaccggactcaaaggcacag

SEQ ID NO: 1293 - DNA, 50 bp, Artificial Sequence
  Synthetic
cccatccttgaacaaatacagctggttcccaatctccgcgatggcgtcga

SEQ ID NO: 1294 - DNA, 100 bp, Artificial Sequence
  Synthetic
gccaaggatgggctggaggtcattcagttggtctgtctcttccctggaaaccttctgcaaagatggtgtggtgtacgtggcttccctgtaaccacatggg

SEQ ID NO: 1295 - DNA, 45 bp, Artificial Sequence
  Synthetic
tttccagggaagagacagaccaactgaatgacctccagcccatcc

SEQ ID NO: 1296 - DNA, 48 bp, Artificial Sequence
  Synthetic
catgtggttacagggaagccacgtacaccacaccatctttgcagaagg

SEQ ID NO: 1297 - DNA, 100 bp, Artificial Sequence
  Synthetic
ccaacggcaggtggatgcaagaagaaatgttccccaaaacgacccagtgacagtggtggtactgaaagcaacagcgccatttaaatacgagtccccagaa

SEQ ID NO: 1298 - DNA, 50 bp, Artificial Sequence
  Synthetic
tcactgggtcgttttggggaacatttcttcttgcatccacctgccgttgg

SEQ ID NO: 1299 - DNA, 50 bp, Artificial Sequence
  Synthetic
ttctggggactcgtatttaaatggcgctgttgctttcagtaccaccactg

SEQ ID NO: 1300 - DNA, 100 bp, Artificial Sequence
  Synthetic
ttctcttacccagagatgcccatgagctgacattttactcatccctctgcctccaagaaggcctgtattatacgtgtcctcctgggggttggagatgatc

SEQ ID NO: 1301 - DNA, 50 bp, Artificial Sequence
  Synthetic
gcagagggatgagtaaaatgtcagctcatgggcatctctgggtaagagaa

SEQ ID NO: 1302 - DNA, 45 bp, Artificial Sequence
  Synthetic
tctccaacccccaggaggacacgtataatacaggccttcttggag

SEQ ID NO: 1303 - DNA, 100 bp, Artificial Sequence
  Synthetic
gctgtgaagcgctattatacattcaacacctaccctggctgcacagatctcaattctcccaacttcaattttcaggccaacacggatgatggctcctgcg

SEQ ID NO: 1304 - DNA, 46 bp, Artificial Sequence
  Synthetic
agatctgtgcagccagggtaggtgttgaatgtataatagcgcttca

SEQ ID NO: 1305 - DNA, 50 bp, Artificial Sequence
  Synthetic
cgcaggagccatcatccgtgttggcctgaaaattgaagttgggagaattg

SEQ ID NO: 1306 - DNA, 100 bp, Artificial Sequence
  Synthetic
cttctgatgatcccagcagggatctatgcacccatctgtgtgactgtgtggtaccctctctggggaggcattatgtatattatttccggatcactcctgg

SEQ ID NO: 1307 - DNA, 35 bp, Artificial Sequence
  Synthetic
cacacagtcacacagatgggtgcatagatccctgc

SEQ ID NO: 1308 - DNA, 50 bp, Artificial Sequence
  Synthetic
ccaggagtgatccggaaataatatacataatgcctccccagagagggtac

SEQ ID NO: 1309 - DNA, 100 bp, Artificial Sequence
  Synthetic
ccactttggagttgtctaccacggagaatacatagaccaggcccagaatcgaatccaatgtgccatcaagtcactaagtcgcatcacagagatgcagcag

SEQ ID NO: 1310 - DNA, 49 bp, Artificial Sequence
  Synthetic
gattctgggcctggtctatgtattctccgtggtagacaactccaaagtg

SEQ ID NO: 1311 - DNA, 50 bp, Artificial Sequence
  Synthetic
ctgctgcatctctgtgatgcgacttagtgacttgatggcacattggattc

SEQ ID NO: 1312 - DNA, 100 bp, Artificial Sequence
  Synthetic
gccgctgccgggttgccagcggagtcgcgcgtcgggagctacgtagggcagagaagtcatggcttctccgtccaaaggcaatgacttgttttcgcccgac

SEQ ID NO: 1313 - DNA, 42 bp, Artificial Sequence
  Synthetic
tgccctacgtagctcccgacgcgcgactccgctggcaacccg

SEQ ID NO: 1314 - DNA, 50 bp, Artificial Sequence
  Synthetic
gtcgggcgaaaacaagtcattgcctttggacggagaagccatgacttctc

SEQ ID NO: 1315 - DNA, 100 bp, Artificial Sequence
  Synthetic
tggaggtgttggccccatgacagtggcaatgctaatgaagaataccattattgctgcaaaaaaggtgctgaggcttgaagagcgagaagtgctgaagtct

SEQ ID NO: 1316 - DNA, 50 bp, Artificial Sequence
  Synthetic
taatggtattcttcattagcattgccactgtcatggggccaacacctcca

SEQ ID NO: 1317 - DNA, 50 bp, Artificial Sequence
  Synthetic
agacttcagcacttctcgctcttcaagcctcagcaccttttttgcagcaa

SEQ ID NO: 1318 - DNA, 100 bp, Artificial Sequence
  Synthetic
aacctgcaaacacaaattcagttacagcttagctgtccgaattaggaaccgcttacatagccgcacctgctaaatgcagttacacagcaatactgacttc

SEQ ID NO: 1319 - DNA, 50 bp, Artificial Sequence
  Synthetic
ggttcctaattcggacagctaagctgtaactgaatttgtgtttgcaggtt

SEQ ID NO: 1320 - DNA, 50 bp, Artificial Sequence
  Synthetic
gaagtcagtattgctgtgtaactgcatttagcaggtgcggctatgtaagc

SEQ ID NO: 1321 - DNA, 100 bp, Artificial Sequence
  Synthetic
tcttctagacacaggttttcccaggtcaaatgcggggaccccagccatatctcccaccctgagaaattttggagtttcagggagctcagaagctctgcag

SEQ ID NO: 1322 - DNA, 50 bp, Artificial Sequence
  Synthetic
atatggctggggtccccgcatttgacctgggaaaacctgtgtctagaaga

SEQ ID NO: 1323 - DNA, 50 bp, Artificial Sequence
  Synthetic
ctgcagagcttctgagctccctgaaactccaaaatttctcagggtgggag

SEQ ID NO: 1324 - DNA, 100 bp, Artificial Sequence
  Synthetic
aactgttgcatggatcctgtgtttgcaactggggagacagaaactgtggttgatagccagtcactgccttaagaacatttgatgcaagatggccagcact

SEQ ID NO: 1325 - DNA, 50 bp, Artificial Sequence
  Synthetic
accacagtttctgtctccccagttgcaaacacaggatccatgcaacagtt

SEQ ID NO: 1326 - DNA, 50 bp, Artificial Sequence
  Synthetic
agtgctggccatcttgcatcaaatgttcttaaggcagtgactggctatca

SEQ ID NO: 1327 - DNA, 100 bp, Artificial Sequence
  Synthetic
ggcaaacgctgtgttatcctctttgcagaccatcccagaatttgcagagactctagaacttattgaatctgatcctgtagcatggagtgacgttaccagt

SEQ ID NO: 1328 - DNA, 50 bp, Artificial Sequence
  Synthetic
tctctgcaaattctgggatggtctgcaaagaggataacacagcgtttgcc

SEQ ID NO: 1329 - DNA, 50 bp, Artificial Sequence
  Synthetic
actggtaacgtcactccatgctacaggatcagattcaataagttctagag

SEQ ID NO: 1330 - DNA, 100 bp, Artificial Sequence
  Synthetic
tcggacaccgaggagaatgtcaagaggcgaacacacaacgtcttggagcgccagaggaggaacgagctaaaacggagcttttttgccctgcgtgaccaga

SEQ ID NO: 1331 - DNA, 45 bp, Artificial Sequence
  Synthetic
cgctccaagacgttgtgtgttcgcctcttgacattctcctcggtg

SEQ ID NO: 1332 - DNA, 50 bp, Artificial Sequence
  Synthetic
tctggtcacgcagggcaaaaaagctccgttttagctcgttcctcctctgg

SEQ ID NO: 1333 - DNA, 100 bp, Artificial Sequence
  Synthetic
acgtttttctaggtacagctcccaggaacagctaggtgggaaagtcccatcactgagggagcctaaccatgtccctgaacaaaaattgggcactcatcta

SEQ ID NO: 1334 - DNA, 50 bp, Artificial Sequence
  Synthetic
atgggactttcccacctagctgttcctgggagctgtacctagaaaaacgt

SEQ ID NO: 1335 - DNA, 50 bp, Artificial Sequence
  Synthetic
tagatgagtgcccaatttttgttcagggacatggttaggctccctcagtg

SEQ ID NO: 1336 - DNA, 100 bp, Artificial Sequence
  Synthetic
cgacgccttcgtaaaggggatctacgggcggctgttcgtgtggattgtggacaagatcaacgcagcaatttacaagcctccctcccaggatgtgaagaac

SEQ ID NO: 1337 - DNA, 45 bp, Artificial Sequence
  Synthetic
ccacaatccacacgaacagccgcccgtagatcccctttacgaagg

SEQ ID NO: 1338 - DNA, 45 bp, Artificial Sequence
  Synthetic
tcacatcctgggagggaggcttgtaaattgctgcgttgatcttgt

SEQ ID NO: 1339 - DNA, 100 bp, Artificial Sequence
  Synthetic
ttgaaagaggcatttaccgagcgcccaatgtatgcctggcactgggctgggtgctgccacctaagcgagcacgaccaatgcagtctatcagggaggccca

SEQ ID NO: 1340 - DNA, 40 bp, Artificial Sequence
  Synthetic
ccagcccagtgccaggcatacattgggcgctcggtaaatg

SEQ ID NO: 1341 - DNA, 40 bp, Artificial Sequence
  Synthetic
tgatagactgcattggtcgtgctcgcttaggtggcagcac

SEQ ID NO: 1342 - DNA, 100 bp, Artificial Sequence
  Synthetic
gattggccttggccttagaccggccacgtgcacagctccctctttaataaacgcttaggggttgcactgtttttgagaagaggaatttgttgggctcctg

SEQ ID NO: 1343 - DNA, 44 bp, Artificial Sequence
  Synthetic
ttattaaagagggagctgtgcacgtggccggtctaaggccaagg

SEQ ID NO: 1344 - DNA, 50 bp, Artificial Sequence
  Synthetic
caggagcccaacaaattcctcttctcaaaaacagtgcaacccctaagcgt

SEQ ID NO: 1345 - DNA, 100 bp, Artificial Sequence
  Synthetic
ttccttatctggaaaagacagccaaaaaaggtcgcccaatggtgatctccagtgggatgcagtcaatggacaccatgaagcaagtttatcagatcgtgaa

SEQ ID NO: 1346 - DNA, 50 bp, Artificial Sequence
  Synthetic
ggagatcaccattgggcgaccttttttggctgtcttttccagataaggaa

SEQ ID NO: 1347 - DNA, 50 bp, Artificial Sequence
  Synthetic
ttcacgatctgataaacttgcttcatggtgtccattgactgcatcccact

SEQ ID NO: 1348 - DNA, 100 bp, Artificial Sequence
  Synthetic
tttggctgtgagccaggcctaggatggttcttgtcctatatccacctagtcttcacctggggctataattctgtcctggaaaaagaactctgaaaacctg

SEQ ID NO: 1349 - DNA, 50 bp, Artificial Sequence
  Synthetic
actaggtggatataggacaagaaccatcctaggcctggctcacagccaaa

SEQ ID NO: 1350 - DNA, 50 bp, Artificial Sequence
  Synthetic
caggttttcagagttctttttccaggacagaattatagccccaggtgaag

SEQ ID NO: 1351 - DNA, 100 bp, Artificial Sequence
  Synthetic
gactacaaagaattactgtgatcctcagggccatcccagtacaggattaaagacaacaactccaggaccaagcctttcacaaggcgtgtcagttgatgaa

SEQ ID NO: 1352 - DNA, 50 bp, Artificial Sequence
  Synthetic
ttaatcctgtactgggatggccctgaggatcacagtaattctttgtagtc

SEQ ID NO: 1353 - DNA, 50 bp, Artificial Sequence
  Synthetic
ttcatcaactgacacgccttgtgaaaggcttggtcctggagttgttgtct

SEQ ID NO: 1354 - DNA, 100 bp, Artificial Sequence
  Synthetic
gtattgcaccatcagcaaagactttgccaaaaattgtagggcgcaccaaggatgtgaaagaggctgtcagaaagctggcttatcaggttttagctgaaaa

SEQ ID NO: 1355 - DNA, 50 bp, Artificial Sequence
  Synthetic
cttggtgcgccctacaatttttggcaaagtctttgctgatggtgcaatac

SEQ ID NO: 1356 - DNA, 50 bp, Artificial Sequence
  Synthetic
ttttcagctaaaacctgataagccagctttctgacagcctctttcacatc

SEQ ID NO: 1357 - DNA, 100 bp, Artificial Sequence
  Synthetic
tgctactattctgaccaagtccactttggagaaccagaattggagagctaccacccttcctacagatttcaactacaatgttgacactctggtccagctt

SEQ ID NO: 1358 - DNA, 50 bp, Artificial Sequence
  Synthetic
tagctctccaattctggttctccaaagtggacttggtcagaatagtagca

SEQ ID NO: 1359 - DNA, 50 bp, Artificial Sequence
  Synthetic
aagctggaccagagtgtcaacattgtagttgaaatctgtaggaagggtgg

SEQ ID NO: 1360 - DNA, 100 bp, Artificial Sequence
  Synthetic
gccactaaggcagccctgctaggggagacgctccaacctgtcttctctctgtctcctggcagctctcttggcctcctagtttctacctaatcatgtccct

SEQ ID NO: 1361 - DNA, 35 bp, Artificial Sequence
  Synthetic
agagagaagacaggttggagcgtctcccctagcag

SEQ ID NO: 1362 - DNA, 50 bp, Artificial Sequence
  Synthetic
agggacatgattaggtagaaactaggaggccaagagagctgccaggagac

SEQ ID NO: 1363 - DNA, 100 bp, Artificial Sequence
  Synthetic
agtaggatccagagccattttggaactttaccaaggattaaggatgagcacagatcacatcaagagtctaaatatcactttggaggccatgtgcagatca

SEQ ID NO: 1364 - DNA, 50 bp, Artificial Sequence
  Synthetic
tgctcatccttaatccttggtaaagttccaaaatggctctggatcctact

SEQ ID NO: 1365 - DNA, 50 bp, Artificial Sequence
  Synthetic
tgatctgcacatggcctccaaagtgatatttagactcttgatgtgatctg

SEQ ID NO: 1366 - DNA, 100 bp, Artificial Sequence
  Synthetic
ggctccatctgacttaaaaactttgcagagaagatgcctagtacctggatggtatgcagtccacatagaaagatggctaacttactttgctacttctcag

SEQ ID NO: 1367 - DNA, 49 bp, Artificial Sequence
  Synthetic
atccaggtactaggcatcttctctgcaaagtttttaagtcagatggagc

SEQ ID NO: 1368 - DNA, 50 bp, Artificial Sequence
  Synthetic
ctgagaagtagcaaagtaagttagccatctttctatgtggactgcatacc

SEQ ID NO: 1369 - DNA, 100 bp, Artificial Sequence
  Synthetic
ggggtggcattcacttagggtctgacttcacagctatgacaaaaccgaaaaagcaaaactgcgaggaagtgctaagatgtacgggtcttggggatatctg

SEQ ID NO: 1370 - DNA, 50 bp, Artificial Sequence
  Synthetic
tttcggttttgtcatagctgtgaagtcagaccctaagtgaatgccacccc

SEQ ID NO: 1371 - DNA, 50 bp, Artificial Sequence
  Synthetic
cagatatccccaagacccgtacatcttagcacttcctcgcagttttgctt

SEQ ID NO: 1372 - DNA, 100 bp, Artificial Sequence
  Synthetic
ctctcctctcctccttgtctggctctgttgacaaaccgggcatgtttggcagtaaattggcaccgtgtcacactgtttcctgggattcaagtatgcaacc

SEQ ID NO: 1373 - DNA, 50 bp, Artificial Sequence
  Synthetic
gccaaacatgcccggtttgtcaacagagccagacaaggaggagaggagag

SEQ ID NO: 1374 - DNA, 50 bp, Artificial Sequence
  Synthetic
ggttgcatacttgaatcccaggaaacagtgtgacacggtgccaatttact

SEQ ID NO: 1375 - DNA, 100 bp, Artificial Sequence
  Synthetic
ttagcaggaggctctccttgcttgcactcaccctttcttattgtcttgccctgcatctgggggtctgaatttttgggagcaggcaatatctgaaggtgca

SEQ ID NO: 1376 - DNA, 50 bp, Artificial Sequence
  Synthetic
ggcaagacaataagaaagggtgagtgcaagcaaggagagcctcctgctaa

SEQ ID NO: 1377 - DNA, 50 bp, Artificial Sequence
  Synthetic
tgcaccttcagatattgcctgctcccaaaaattcagacccccagatgcag

SEQ ID NO: 1378 - DNA, 100 bp, Artificial Sequence
  Synthetic
gcatcgggaagcaggagcatcttcttggcagccaggctgggccatcttctcctggacacctgctgtgtaccaggaacttcgtcacctccttgaatgctgg

SEQ ID NO: 1379 - DNA, 35 bp, Artificial Sequence
  Synthetic
agaagatggcccagcctggctgccaagaagatgct

SEQ ID NO: 1380 - DNA, 45 bp, Artificial Sequence
  Synthetic
attcaaggaggtgacgaagttcctggtacacagcaggtgtccagg

SEQ ID NO: 1381 - DNA, 100 bp, Artificial Sequence
  Synthetic
tggttctaagatttctcatcttctcatccctaggacaagcatagtgcctgcatgcttcatgatcagtaagtcctggctgcataaaggactctgatgtcaa

SEQ ID NO: 1382 - DNA, 50 bp, Artificial Sequence
  Synthetic
caggcactatgcttgtcctagggatgagaagatgagaaatcttagaacca

SEQ ID NO: 1383 - DNA, 50 bp, Artificial Sequence
  Synthetic
ttgacatcagagtcctttatgcagccaggacttactgatcatgaagcatg

SEQ ID NO: 1384 - DNA, 100 bp, Artificial Sequence
  Synthetic
ccagtaccagcgtttcacctaccttcccgccaacggtaacgccatctttctaaccgtaagccgtgaacatgagcgcgtggggtgctttttctaaagacgc

SEQ ID NO: 1385 - DNA, 50 bp, Artificial Sequence
  Synthetic
gaaagatggcgttaccgttggcgggaaggtaggtgaaacgctggtactgg

SEQ ID NO: 1386 - DNA, 50 bp, Artificial Sequence
  Synthetic
gcgtctttagaaaaagcaccccacgcgctcatgttcacggcttacggtta

SEQ ID NO: 1387 - DNA, 100 bp, Artificial Sequence
  Synthetic
cctttctttctcctcgccggcccgagagcaggaacacgataacgaaggaggcccaacttcattcaataaggagcctgacggatttatcccagacggtaga

SEQ ID NO: 1388 - DNA, 50 bp, Artificial Sequence
  Synthetic
ctccttcgttatcgtgttcctgctctcgggccggcgaggagaaagaaagg

SEQ ID NO: 1389 - DNA, 50 bp, Artificial Sequence
  Synthetic
tctaccgtctgggataaatccgtcaggctccttattgaatgaagttgggc

SEQ ID NO: 1390 - DNA, 100 bp, Artificial Sequence
  Synthetic
ggatgaggagagctatgacacagagtcagagttcacggagttcacagaggacgagctgccctatgatgactgtgtgtttggaggccagcgtctgacgtta

SEQ ID NO: 1391 - DNA, 39 bp, Artificial Sequence
  Synthetic
cctctgtgaactccgtgaactctgactctgtgtcatagc

SEQ ID NO: 1392 - DNA, 35 bp, Artificial Sequence
  Synthetic
gcctccaaacacacagtcatcatagggcagctcgt

SEQ ID NO: 1393 - DNA, 100 bp, Artificial Sequence
  Synthetic
atttggttcccgatggccctgtgggagaacagatccgacgtatcctgaagggaaagtccattcagcagagagctccaccgtattagctccattagcttgg

SEQ ID NO: 1394 - DNA, 50 bp, Artificial Sequence
  Synthetic
cttcaggatacgtcggatctgttctcccacagggccatcgggaaccaaat

SEQ ID NO: 1395 - DNA, 50 bp, Artificial Sequence
  Synthetic
ccaagctaatggagctaatacggtggagctctctgctgaatggactttcc

SEQ ID NO: 1396 - DNA, 100 bp, Artificial Sequence
  Synthetic
ctctggctctcccaccctcttcccgtctttctctgcttccttgtcactgttactccaggagacgttcacttttcaccaacctttctccaagcatctccaa

SEQ ID NO: 1397 - DNA, 50 bp, Artificial Sequence
  Synthetic
acagtgacaaggaagcagagaaagacgggaagagggtgggagagccagag

SEQ ID NO: 1398 - DNA, 50 bp, Artificial Sequence
  Synthetic
ttggagatgcttggagaaaggttggtgaaaagtgaacgtctcctggagta

SEQ ID NO: 1399 - DNA, 100 bp, Artificial Sequence
  Synthetic
aacgatttctcaggttgagatgatcaccgtgaatccggcttcctctgagcattcgatggccttagcacctcatcaagccagcacatcctgcctgctgttg

SEQ ID NO: 1400 - DNA, 50 bp, Artificial Sequence
  Synthetic
gctcagaggaagccggattcacggtgatcatctcaacctgagaaatcgtt

SEQ ID NO: 1401 - DNA, 41 bp, Artificial Sequence
  Synthetic
gcaggatgtgctggcttgatgaggtgctaaggccatcgaat

SEQ ID NO: 1402 - DNA, 100 bp, Artificial Sequence
  Synthetic
gttgagattgtactccagtgccttgatgtcatgctaactaagcgcagaaagcaagtttctcagcagcgagctcttgccttcatcaaacgcctttgtaccc

SEQ ID NO: 1403 - DNA, 50 bp, Artificial Sequence
  Synthetic
tttctgcgcttagttagcatgacatcaaggcactggagtacaatctcaac

SEQ ID NO: 1404 - DNA, 50 bp, Artificial Sequence
  Synthetic
gggtacaaaggcgtttgatgaaggcaagagctcgctgctgagaaacttgc

SEQ ID NO: 1405 - DNA, 100 bp, Artificial Sequence
  Synthetic
ctgatccacaaacacaagcgtgaatttaaaggggccgttcgagaaatccgcaaggacaatcagttcctggcgaggatgcaactctcagaaatcatggaac

SEQ ID NO: 1406 - DNA, 50 bp, Artificial Sequence
  Synthetic
cggatttctcgaacggcccctttaaattcacgcttgtgtttgtggatcag

SEQ ID NO: 1407 - DNA, 49 bp, Artificial Sequence
  Synthetic
ttccatgatttctgagagttgcatcctcgccaggaactgattgtccttg

SEQ ID NO: 1408 - DNA, 100 bp, Artificial Sequence
  Synthetic
ttctctatgcgtgtcagggagtggtacgggtatcactttccggagctggtgaagatcatcaacgacaatgccacatactgccgtcttgcccagtttattg

SEQ ID NO: 1409 - DNA, 50 bp, Artificial Sequence
  Synthetic
accagctccggaaagtgatacccgtaccactccctgacacgcatagagaa

SEQ ID NO: 1410 - DNA, 50 bp, Artificial Sequence
  Synthetic
caataaactgggcaagacggcagtatgtggcattgtcgttgatgatcttc

SEQ ID NO: 1411 - DNA, 100 bp, Artificial Sequence
  Synthetic
ctgccaggcttcaccggccagaactgtgaggaaaatatcgacgattgtccaggaaacaactgcaagaacgggggtgcctgtgtggacggcgtgaacacct

SEQ ID NO: 1412 - DNA, 50 bp, Artificial Sequence
  Synthetic
ggacaatcgtcgatattttcctcacagttctggccggtgaagcctggcag

SEQ ID NO: 1413 - DNA, 36 bp, Artificial Sequence
  Synthetic
tccacacaggcacccccgttcttgcagttgtttcct

SEQ ID NO: 1414 - DNA, 100 bp, Artificial Sequence
  Synthetic
tcctggtgaacaagaacaggaggtggctggctctaaagtctttctggaaattgacaaccgccagtgtgttcaagactcagaccactgcttcaagaacacg

SEQ ID NO: 1415 - DNA, 50 bp, Artificial Sequence
  Synthetic
tttccagaaagactttagagccagccacctcctgttcttgttcaccagga

SEQ ID NO: 1416 - DNA, 50 bp, Artificial Sequence
  Synthetic
cgtgttcttgaagcagtggtctgagtcttgaacacactggcggttgtcaa

SEQ ID NO: 1417 - DNA, 100 bp, Artificial Sequence
  Synthetic
tacatctacatccaccactgggacaagccatcttgtaaaatgtgcggagaaggagaaaactttctgtgtgaatggaggggagtgcttcatggtgaaagac

SEQ ID NO: 1418 - DNA, 50 bp, Artificial Sequence
  Synthetic
tctccgcacattttacaagatggcttgtcccagtggtggatgtagatgta

SEQ ID NO: 1419 - DNA, 50 bp, Artificial Sequence
  Synthetic
gtctttcaccatgaagcactcccctccattcacacagaaagttttctcct

SEQ ID NO: 1420 - DNA, 100 bp, Artificial Sequence
  Synthetic
gacttccagtaggaggcggcaagtttgaaaagtgatgacggttgacgtttgctgatttttgactttgcttgtagctgctccccgaactcgccgtcttcct

SEQ ID NO: 1421 - DNA, 50 bp, Artificial Sequence
  Synthetic
aaacgtcaaccgtcatcacttttcaaacttgccgcctcctactggaagtc

SEQ ID NO: 1422 - DNA, 50 bp, Artificial Sequence
  Synthetic
aggaagacggcgagttcggggagcagctacaagcaaagtcaaaaatcagc

SEQ ID NO: 1423 - DNA, 100 bp, Artificial Sequence
  Synthetic
ggcactgcaaagacggcaacaaccacacctgctacagggttttctttctccacctctggcactggagggtttaattttggggctcccttccaaccagcca

SEQ ID NO: 1424 - DNA, 50 bp, Artificial Sequence
  Synthetic
gagaaagaaaaccctgtagcaggtgtggttgttgccgtctttgcagtgcc

SEQ ID NO: 1425 - DNA, 47 bp, Artificial Sequence
  Synthetic
ctggttggaagggagccccaaaattaaaccctccagtgccagaggtg

SEQ ID NO: 1426 - DNA, 100 bp, Artificial Sequence
  Synthetic
tcaagcgctctgctatctctgcagctaaaacgggtgtcaggttttcagctgctactaaagataatgagcataagcgttcactgaccaagactccagccag

SEQ ID NO: 1427 - DNA, 50 bp, Artificial Sequence
  Synthetic
agctgaaaacctgacacccgttttagctgcagagatagcagagcgcttga

SEQ ID NO: 1428 - DNA, 50 bp, Artificial Sequence
  Synthetic
ctggctggagtcttggtcagtgaacgcttatgctcattatctttagtagc

SEQ ID NO: 1429 - DNA, 100 bp, Artificial Sequence
  Synthetic
aagcaaaggaatggttatcctctccctgcttcaaggatgggactggaaacccaataccaccttggaaagtgccgacaatgcagacaccaggaagttgtgg

SEQ ID NO: 1430 - DNA, 50 bp, Artificial Sequence
  Synthetic
gtttccagtcccatccttgaagcagggagaggataaccattcctttgctt

SEQ ID NO: 1431 - DNA, 50 bp, Artificial Sequence
  Synthetic
ccacaacttcctggtgtctgcattgtcggcactttccaaggtggtattgg

SEQ ID NO: 1432 - DNA, 100 bp, Artificial Sequence
  Synthetic
gagtgccttagacagcctgactctccacaaaccactgttaaaacttacctgctaggaatgctagattgaatgggatgggaagagccttccctcattattg

SEQ ID NO: 1433 - DNA, 50 bp, Artificial Sequence
  Synthetic
aggtaagttttaacagtggtttgtggagagtcaggctgtctaaggcactc

SEQ ID NO: 1434 - DNA, 50 bp, Artificial Sequence
  Synthetic
caataatgagggaaggctcttcccatcccattcaatctagcattcctagc

SEQ ID NO: 1435 - DNA, 100 bp, Artificial Sequence
  Synthetic
ctgagaccatatccttaaatgtaaaaggccctggactacagaggatggtgcttgttgacttaccaggtgtgattaatactgtgacatcaggcatggctcc

SEQ ID NO: 1436 - DNA, 50 bp, Artificial Sequence
  Synthetic
caccatcctctgtagtccagggccttttacatttaaggatatggtctcag

SEQ ID NO: 1437 - DNA, 50 bp, Artificial Sequence
  Synthetic
ggagccatgcctgatgtcacagtattaatcacacctggtaagtcaacaag

SEQ ID NO: 1438 - DNA, 100 bp, Artificial Sequence
  Synthetic
actcacctcctcctggtcaacatcagcctcagcgacctgctggtgtccctcttcggggtcacctttaccttcgtgtcctgcctgaggaacggctgggtgt

SEQ ID NO: 1439 - DNA, 35 bp, Artificial Sequence
  Synthetic
agggacaccagcaggtcgctgaggctgatgttgac

SEQ ID NO: 1440 - DNA, 45 bp, Artificial Sequence
  Synthetic
cagccgttcctcaggcaggacacgaaggtaaaggtgaccccgaag

SEQ ID NO: 1441 - DNA, 100 bp, Artificial Sequence
  Synthetic
agaggattgaacaactgcagagagaaaggcggcgggtcttagaagaaaatcatgtggagcaccagcctcggtttttcaggaaatccgacgatgactcttg

SEQ ID NO: 1442 - DNA, 50 bp, Artificial Sequence
  Synthetic
attttcttctaagacccgccgcctttctctctgcagttgttcaatcctct

SEQ ID NO: 1443 - DNA, 50 bp, Artificial Sequence
  Synthetic
caagagtcatcgtcggatttcctgaaaaaccgaggctggtgctccacatg

SEQ ID NO: 1444 - DNA, 100 bp, Artificial Sequence
  Synthetic
tggattgctgggggtttgtagagaaaggtgacaaatttcagtacctctggcatgctgtcccaggaaactagggctcccactaacttatgaggtttttaaa

SEQ ID NO: 1445 - DNA, 50 bp, Artificial Sequence
  Synthetic
ccagaggtactgaaatttgtcacctttctctacaaacccccagcaatcca

SEQ ID NO: 1446 - DNA, 50 bp, Artificial Sequence
  Synthetic
tttaaaaacctcataagttagtgggagccctagtttcctgggacagcatg

SEQ ID NO: 1447 - DNA, 100 bp, Artificial Sequence
  Synthetic
tcacatgatggggttctttagtacatggtaacagccatgtcatcttacacacctagcattgtgaatgctgtagtgacatcctttataggcaccttacagc

SEQ ID NO: 1448 - DNA, 50 bp, Artificial Sequence
  Synthetic
gtgtaagatgacatggctgttaccatgtactaaagaaccccatcatgtga

SEQ ID NO: 1449 - DNA, 50 bp, Artificial Sequence
  Synthetic
gctgtaaggtgcctataaaggatgtcactacagcattcacaatgctaggt

SEQ ID NO: 1450 - DNA, 100 bp, Artificial Sequence
  Synthetic
gaccatgcctggtgccacagccatggtttccatttctagatgaaaggatggcctaggacataggtctcaaagactcttggatcagaatcaggagattagg

SEQ ID NO: 1451 - DNA, 50 bp, Artificial Sequence
  Synthetic
catcctttcatctagaaatggaaaccatggctgtggcaccaggcatggtc

SEQ ID NO: 1452 - DNA, 48 bp, Artificial Sequence
  Synthetic
taatctcctgattctgatccaagagtctttgagacctatgtcctaggc

SEQ ID NO: 1453 - DNA, 100 bp, Artificial Sequence
  Synthetic
ctttaactaggggcgcgcagatgtgtgaggccttttattgtgagagtggacagacatccgagatttcagagccccatattcgagccccgtggaatcccgc

SEQ ID NO: 1454 - DNA, 50 bp, Artificial Sequence
  Synthetic
tccactctcacaataaaaggcctcacacatctgcgcgcccctagttaaag

SEQ ID NO: 1455 - DNA, 47 bp, Artificial Sequence
  Synthetic
ggattccacggggctcgaatatggggctctgaaatctcggatgtctg

SEQ ID NO: 1456 - DNA, 100 bp, Artificial Sequence
  Synthetic
ggtgttggaggcactcaaggacctcatcaacgaggcctgctgggatattagctccagcggtgtaaacctgcagagcatggactcgtcccacgtctctttg

SEQ ID NO: 1457 - DNA, 39 bp, Artificial Sequence
  Synthetic
taatatcccagcaggcctcgttgatgaggtccttgagtg

SEQ ID NO: 1458 - DNA, 35 bp, Artificial Sequence
  Synthetic
cgagtccatgctctgcaggtttacaccgctggagc

SEQ ID NO: 1459 - DNA, 100 bp, Artificial Sequence
  Synthetic
tgtggagctgtggcaagtcctcatatcaaatacagaacatgatcttcctcctgctaatgttgagcctggaattgcagcttcaccagatagcagctttatt

SEQ ID NO: 1460 - DNA, 50 bp, Artificial Sequence
  Synthetic
gaggaagatcatgttctgtatttgatatgaggacttgccacagctccaca

SEQ ID NO: 1461 - DNA, 50 bp, Artificial Sequence
  Synthetic
aataaagctgctatctggtgaagctgcaattccaggctcaacattagcag

SEQ ID NO: 1462 - DNA, 100 bp, Artificial Sequence
  Synthetic
aggagaacttcagcctcaagctgcgcatctacttcctggaggagcgcatgcaacagaagtatgaggccagccgggaggacatctacaagcggaacattga

SEQ ID NO: 1463 - DNA, 36 bp, Artificial Sequence
  Synthetic
catgcgctcctccaggaagtagatgcgcagcttgag

SEQ ID NO: 1464 - DNA, 35 bp, Artificial Sequence
  Synthetic
tagatgtcctcccggctggcctcatacttctgttg

SEQ ID NO: 1465 - DNA, 100 bp, Artificial Sequence
  Synthetic
cagcaggaccaactgcccctgtaagtacagttttttggataaccacaagaagttgactcctcgacgcgatgttcccacttaccccaagtacctgctctct

SEQ ID NO: 1466 - DNA, 50 bp, Artificial Sequence
  Synthetic
tcttgtggttatccaaaaaactgtacttacaggggcagttggtcctgctg

SEQ ID NO: 1467 - DNA, 45 bp, Artificial Sequence
  Synthetic
gcaggtacttggggtaagtgggaacatcgcgtcgaggagtcaact

SEQ ID NO: 1468 - DNA, 100 bp, Artificial Sequence
  Synthetic
tagtgcttggtcgggtcttggggtctggagcgtttgggaaggtggttgaaggaacagcctatggattaagccggtcccaacctgtcatgaaagttgcagt

SEQ ID NO: 1469 - DNA, 50 bp, Artificial Sequence
  Synthetic
ttcaaccaccttcccaaacgctccagaccccaagacccgaccaagcacta

SEQ ID NO: 1470 - DNA, 50 bp, Artificial Sequence
  Synthetic
actgcaactttcatgacaggttgggaccggcttaatccataggctgttcc

SEQ ID NO: 1471 - DNA, 100 bp, Artificial Sequence
  Synthetic
tgaagccagtcatcaaatcccagccagtgcccaagaacaacaagggacccgtcaaggtcgtggtgggaaagacctttgactccattgtgatggaccccaa

SEQ ID NO: 1472 - DNA, 45 bp, Artificial Sequence
  Synthetic
gggtcccttgttgttcttgggcactggctgggatttgatgactgg

SEQ ID NO: 1473 - DNA, 50 bp, Artificial Sequence
  Synthetic
ttggggtccatcacaatggagtcaaaggtctttcccaccacgaccttgac

SEQ ID NO: 1474 - DNA, 100 bp, Artificial Sequence
  Synthetic
gctaccccactttccactactaccactatgggaagttcgcagaaaagtatgacagcgaccgcacagaattgggatttaccaattatattcgagccctccg

SEQ ID NO: 1475 - DNA, 50 bp, Artificial Sequence
  Synthetic
atacttttctgcgaacttcccatagtggtagtagtggaaagtggggtagc

SEQ ID NO: 1476 - DNA, 50 bp, Artificial Sequence
  Synthetic
cggagggctcgaatataattggtaaatcccaattctgtgcggtcgctgtc

SEQ ID NO: 1477 - DNA, 100 bp, Artificial Sequence
  Synthetic
aatcagaacactgatccaatgaggaatggagcttgtttctgtgacccaggagaacttagtgcaagactacaggagttaacagatggccagctccttattt

SEQ ID NO: 1478 - DNA, 50 bp, Artificial Sequence
  Synthetic
cctgggtcacagaaacaagctccattcctcattggatcagtgttctgatt

SEQ ID NO: 1479 - DNA, 50 bp, Artificial Sequence
  Synthetic
aaataaggagctggccatctgttaactcctgtagtcttgcactaagttct

SEQ ID NO: 1480 - DNA, 100 bp, Artificial Sequence
  Synthetic
ggatcccaacaagccctcaggattcagaagtgttaaagctcctgtcactaaagtggctgcgtcgattggaaatgctcagaagttgcctatgtgtgacaaa

SEQ ID NO: 1481 - DNA, 49 bp, Artificial Sequence
  Synthetic
tagtgacaggagctttaacacttctgaatcctgagggcttgttgggatc

SEQ ID NO: 1482 - DNA, 50 bp, Artificial Sequence
  Synthetic
tttgtcacacataggcaacttctgagcatttccaatcgacgcagccactt

SEQ ID NO: 1483 - DNA, 100 bp, Artificial Sequence
  Synthetic
ctttgggacagagtccatgactcatgctgatgcgcaggacaggattaaagcagcagctcaccagctgtgtctcaaaattgacaggggagaaactcactta

SEQ ID NO: 1484 - DNA, 42 bp, Artificial Sequence
  Synthetic
ctttaatcctgtcctgcgcatcagcatgagtcatggactctg

SEQ ID NO: 1485 - DNA, 50 bp, Artificial Sequence
  Synthetic
taagtgagtttctcccctgtcaattttgagacacagctggtgagctgctg

SEQ ID NO: 1486 - DNA, 100 bp, Artificial Sequence
  Synthetic
ctccaggaaccagcgaagaccgctataagtctggcttgacaactctggtggcaacaagtgtcaacagtgtaacaggcattcgcatcgaggatctgccaac

SEQ ID NO: 1487 - DNA, 45 bp, Artificial Sequence
  Synthetic
caccagagttgtcaagccagacttatagcggtcttcgctggttcc

SEQ ID NO: 1488 - DNA, 50 bp, Artificial Sequence
  Synthetic
gttggcagatcctcgatgcgaatgcctgttacactgttgacacttgttgc

SEQ ID NO: 1489 - DNA, 100 bp, Artificial Sequence
  Synthetic
atctgcactgcaggtattgacaaagtggtcaagaaaagcaacacagtccagatagtcgtatgtgaaatgctctcccagcccaggatttcttatgatgccc

SEQ ID NO: 1490 - DNA, 45 bp, Artificial Sequence
  Synthetic
tggactgtgttgcttttcttgaccactttgtcaatacctgcagtg

SEQ ID NO: 1491 - DNA, 50 bp, Artificial Sequence
  Synthetic
gggcatcataagaaatcctgggctgggagagcatttcacatacgactatc

SEQ ID NO: 1492 - DNA, 100 bp, Artificial Sequence
  Synthetic
cattgtccctactaaagctggatttccattagctgtgcattctggagctgcaagagcaggtgtttacaacctcaccaaatctttagctttggaatgggcc

SEQ ID NO: 1493 - DNA, 50 bp, Artificial Sequence
  Synthetic
cagctccagaatgcacagctaatggaaatccagctttagtagggacaatg

SEQ ID NO: 1494 - DNA, 50 bp, Artificial Sequence
  Synthetic
ggcccattccaaagctaaagatttggtgaggttgtaaacacctgctcttg

SEQ ID NO: 1495 - DNA, 100 bp, Artificial Sequence
  Synthetic
atggaaaagctccccttatccaacagagtttaaaagtagtgacttgggtttttgcgagtgctttgtttactaaggactttggggaggaaccatgctaagc

SEQ ID NO: 1496 - DNA, 50 bp, Artificial Sequence
  Synthetic
aacccaagtcactacttttaaactctgttggataaggggagcttttccat

SEQ ID NO: 1497 - DNA, 50 bp, Artificial Sequence
  Synthetic
gcttagcatggttcctccccaaagtccttagtaaacaaagcactcgcaaa

SEQ ID NO: 1498 - DNA, 100 bp, Artificial Sequence
  Synthetic
gaaaaaaacattcccagtggcagcctgcctaagactgtcttaccttatgttaaggaagtcaggtatttaaaatgttacatatgccggcgcagtggctcat

SEQ ID NO: 1499 - DNA, 50 bp, Artificial Sequence
  Synthetic
acataaggtaagacagtcttaggcaggctgccactgggaatgtttttttc

SEQ ID NO: 1500 - DNA, 50 bp, Artificial Sequence
  Synthetic
atgagccactgcgccggcatatgtaacattttaaatacctgacttcctta

SEQ ID NO: 1501 - DNA, 100 bp, Artificial Sequence
  Synthetic
ctacatctcccacaggaagtgtcacacagcagtcaagtatgtcccaaacgtctatcaacctctccacttctcctacacctgcacagttaataagccgttc

SEQ ID NO: 1502 - DNA, 45 bp, Artificial Sequence
  Synthetic
cgtttgggacatacttgactgctgtgtgacacttcctgtgggaga

SEQ ID NO: 1503 - DNA, 50 bp, Artificial Sequence
  Synthetic
gaacggcttattaactgtgcaggtgtaggagaagtggagaggttgataga

SEQ ID NO: 1504 - DNA, 100 bp, Artificial Sequence
  Synthetic
gtagcctttgtcccttcatgcctttcaattctgagtgggaggaaaagcaaacatcaaaacagtgcttcagccaaattccatatgtaatgccattgggaga

SEQ ID NO: 1505 - DNA, 50 bp, Artificial Sequence
  Synthetic
ttgcttttcctcccactcagaattgaaaggcatgaagggacaaaggctac

SEQ ID NO: 1506 - DNA, 50 bp, Artificial Sequence
  Synthetic
tctcccaatggcattacatatggaatttggctgaagcactgttttgatgt

SEQ ID NO: 1507 - DNA, 100 bp, Artificial Sequence
  Synthetic
ctgtctgtgtcccgacacataatctctgtctcttggacctgccaccatcactttctgggtcaggattggaattgggatggaatgggacagttgtctataa

SEQ ID NO: 1508 - DNA, 50 bp, Artificial Sequence
  Synthetic
tgatggtggcaggtccaagagacagagattatgtgtcgggacacagacag

SEQ ID NO: 1509 - DNA, 50 bp, Artificial Sequence
  Synthetic
ttatagacaactgtcccattccatcccaattccaatcctgacccagaaag

SEQ ID NO: 1510 - DNA, 100 bp, Artificial Sequence
  Synthetic
cctcaggcttgaagagtgtcgaattatgtcctctgcaaaaaggccactgtggttgaattgggagaacccagacatcatgtcagagttactgtttcagaac

SEQ ID NO: 1511 - DNA, 50 bp, Artificial Sequence
  Synthetic
acagtggcctttttgcagaggacataattcgacactcttcaagcctgagg

SEQ ID NO: 1512 - DNA, 50 bp, Artificial Sequence
  Synthetic
gttctgaaacagtaactctgacatgatgtctgggttctcccaattcaacc

SEQ ID NO: 1513 - DNA, 100 bp, Artificial Sequence
  Synthetic
tgacactcattgattctaaagcatctttaatctgccaggcggagggggctttgctggtctttcttggactattccagagaggacaactgtcatctgggaa

SEQ ID NO: 1514 - DNA, 47 bp, Artificial Sequence
  Synthetic
agccccctccgcctggcagattaaagatgctttagaatcaatgagtg

SEQ ID NO: 1515 - DNA, 50 bp, Artificial Sequence
  Synthetic
ttcccagatgacagttgtcctctctggaatagtccaagaaagaccagcaa

SEQ ID NO: 1516 - DNA, 100 bp, Artificial Sequence
  Synthetic
cttcatcatgagttctgctgaatgccgcgatgggtcaggtaggggggaaacaggttgggatgggataggactagcaccattttaagtccctgtcacctct

SEQ ID NO: 1517 - DNA, 50 bp, Artificial Sequence
  Synthetic
tttcccccctacctgacccatcgcggcattcagcagaactcatgatgaag

SEQ ID NO: 1518 - DNA, 50 bp, Artificial Sequence
  Synthetic
agaggtgacagggacttaaaatggtgctagtcctatcccatcccaacctg

SEQ ID NO: 1519 - DNA, 100 bp, Artificial Sequence
  Synthetic
gccatccagcactgccattcccgtggagttgtccatcgtgacatcaaggatgagaacatcctgatagacctacgccgtggctgtgccaaactcattgatt

SEQ ID NO: 1520 - DNA, 48 bp, Artificial Sequence
  Synthetic
tccttgatgtcacgatggacaactccacgggaatggcagtgctggatg

SEQ ID NO: 1521 - DNA, 50 bp, Artificial Sequence
  Synthetic
aatcaatgagtttggcacagccacggcgtaggtctatcaggatgttctca

SEQ ID NO: 1522 - DNA, 100 bp, Artificial Sequence
  Synthetic
ttcattgattacccaaagaaggaggactacatcgtctacctgggtcgctcaaggcttaactccaacacgcaaggggagatgaagtttgaggtggaaaacc

SEQ ID NO: 1523 - DNA, 50 bp, Artificial Sequence
  Synthetic
gagcgacccaggtagacgatgtagtcctccttctttgggtaatcaatgaa

SEQ ID NO: 1524 - DNA, 50 bp, Artificial Sequence
  Synthetic
ggttttccacctcaaacttcatctccccttgcgtgttggagttaagcctt

SEQ ID NO: 1525 - DNA, 100 bp, Artificial Sequence
  Synthetic
aaatgatattgcgttcgtgcctcagctttaagcacaagtagcagcagctcctgcttgagttctgagggcatcatggccctatgattaaccagagtgatct

SEQ ID NO: 1526 - DNA, 50 bp, Artificial Sequence
  Synthetic
gagctgctgctacttgtgcttaaagctgaggcacgaacgcaatatcattt

SEQ ID NO: 1527 - DNA, 50 bp, Artificial Sequence
  Synthetic
agatcactctggttaatcatagggccatgatgccctcagaactcaagcag

SEQ ID NO: 1528 - DNA, 100 bp, Artificial Sequence
  Synthetic
atcgtcgccaccattgccgcaaatgtggttttgttgtctgtgggccctgctctgaaaagagatttcttcttcccagccagtcctctaagcctgtgcggat

SEQ ID NO: 1529 - DNA, 50 bp, Artificial Sequence
  Synthetic
gcagggcccacagacaacaaaaccacatttgcggcaatggtggcgacgat

SEQ ID NO: 1530 - DNA, 50 bp, Artificial Sequence
  Synthetic
atccgcacaggcttagaggactggctgggaagaagaaatctcttttcaga

SEQ ID NO: 1531 - DNA, 100 bp, Artificial Sequence
  Synthetic
cggtttcagcaggtcccatgtagttagcaggacagcacttgagttaggtctgagaaagaacgcctgtttgtcatggcatttcctgtaaggagcccagagc

SEQ ID NO: 1532 - DNA, 50 bp, Artificial Sequence
  Synthetic
gacctaactcaagtgctgtcctgctaactacatgggacctgctgaaaccg

SEQ ID NO: 1533 - DNA, 49 bp, Artificial Sequence
  Synthetic
ctctgggctccttacaggaaatgccatgacaaacaggcgttctttctca

SEQ ID NO: 1534 - DNA, 100 bp, Artificial Sequence
  Synthetic
ccaacagcttgcctctgaggttctggatcaatataataaaaaacccgcagtttgtgttcgacgtgcaaacatctgataacatggatgcggtgctccttgt

SEQ ID NO: 1535 - DNA, 50 bp, Artificial Sequence
  Synthetic
ctgcgggttttttattatattgatccagaacctcagaggcaagctgttgg

SEQ ID NO: 1536 - DNA, 50 bp, Artificial Sequence
  Synthetic
acaaggagcaccgcatccatgttatcagatgtttgcacgtcgaacacaaa

SEQ ID NO: 1537 - DNA, 100 bp, Artificial Sequence
  Synthetic
cgggggaaagcccatccgtactaccaggagactggatccgcaaagtagacacttggtctcatgaagccactgctgggctccagagagaagggaaaactaa

SEQ ID NO: 1538 - DNA, 40 bp, Artificial Sequence
  Synthetic
gtctactttgcggatccagtctcctggtagtacggatggg

SEQ ID NO: 1539 - DNA, 36 bp, Artificial Sequence
  Synthetic
tctctggagcccagcagtggcttcatgagaccaagt

SEQ ID NO: 1540 - DNA, 100 bp, Artificial Sequence
  Synthetic
gctgagacagtcctcatatcctcttgagccaaactgtttgggtctcgttgcttcatggtatggtctggatttgtgggaatggctttgcgtgagaaagggg

SEQ ID NO: 1541 - DNA, 50 bp, Artificial Sequence
  Synthetic
caacgagacccaaacagtttggctcaagaggatatgaggactgtctcagc

SEQ ID NO: 1542 - DNA, 50 bp, Artificial Sequence
  Synthetic
cccctttctcacgcaaagccattcccacaaatccagaccataccatgaag

SEQ ID NO: 1543 - DNA, 100 bp, Artificial Sequence
  Synthetic
gtctaggctgttctgtgcctccaaggactgtctggcaatgacttgtattggccaccaactgtagatgtatatatggtgcccttctgatgctaagactcca

SEQ ID NO: 1544 - DNA, 50 bp, Artificial Sequence
  Synthetic
caatacaagtcattgccagacagtccttggaggcacagaacagcctagac

SEQ ID NO: 1545 - DNA, 47 bp, Artificial Sequence
  Synthetic
agtcttagcatcagaagggcaccatatatacatctacagttggtggc

SEQ ID NO: 1546 - DNA, 100 bp, Artificial Sequence
  Synthetic
gaaaacagttcaacttctgtagtccagaaaccgtcagggaggaagttctgctcaccctcacaccgtgttaggagactactgttatttgaccaatgaattg

SEQ ID NO: 1547 - DNA, 50 bp, Artificial Sequence
  Synthetic
cagaacttcctccctgacggtttctggactacagaagttgaactgttttc

SEQ ID NO: 1548 - DNA, 50 bp, Artificial Sequence
  Synthetic
caattcattggtcaaataacagtagtctcctaacacggtgtgagggtgag

SEQ ID NO: 1549 - DNA, 100 bp, Artificial Sequence
  Synthetic
cgctgttggcatgagtacagtaccagaagttatcgttgcacggcactgtggacttcgagtctttggcttctcactcatcactaacaaggtcatcatggat

SEQ ID NO: 1550 - DNA, 50 bp, Artificial Sequence
  Synthetic
cacagtgccgtgcaacgataacttctggtactgtactcatgccaacagcg

SEQ ID NO: 1551 - DNA, 50 bp, Artificial Sequence
  Synthetic
atccatgatgaccttgttagtgatgagtgagaagccaaagactcgaagtc

SEQ ID NO: 1552 - DNA, 100 bp, Artificial Sequence
  Synthetic
ccctgatgccagagtccttgagctgtcagttcccacagttgctcctttgtttgctcttctcagcctcggccagatttacagtccaggcagcaaaatctca

SEQ ID NO: 1553 - DNA, 50 bp, Artificial Sequence
  Synthetic
acaaaggagcaactgtgggaactgacagctcaaggactctggcatcaggg

SEQ ID NO: 1554 - DNA, 50 bp, Artificial Sequence
  Synthetic
tgagattttgctgcctggactgtaaatctggccgaggctgagaagagcaa

SEQ ID NO: 1555 - DNA, 100 bp, Artificial Sequence
  Synthetic
gctatggggaaactatatggaaatgacttcagccaaactaccatctctcgatttgaagccttgaacctcagctttaagaacatgtgcaagttgaagccac

SEQ ID NO: 1556 - DNA, 50 bp, Artificial Sequence
  Synthetic
cgagagatggtagtttggctgaagtcatttccatatagtttccccatagc

SEQ ID NO: 1557 - DNA, 50 bp, Artificial Sequence
  Synthetic
gtggcttcaacttgcacatgttcttaaagctgaggttcaaggcttcaaat

SEQ ID NO: 1558 - DNA, 100 bp, Artificial Sequence
  Synthetic
atggggcctggcacctcgtctacccaacctcaccggaatgtaagcatctccgctgaacgactccctgcccttaccctacctctgagtttgtccatgttta

SEQ ID NO: 1559 - DNA, 44 bp, Artificial Sequence
  Synthetic
gagatgcttacattccggtgaggttgggtagacgaggtgccagg

SEQ ID NO: 1560 - DNA, 50 bp, Artificial Sequence
  Synthetic
taaacatggacaaactcagaggtagggtaagggcagggagtcgttcagcg

SEQ ID NO: 1561 - DNA, 100 bp, Artificial Sequence
  Synthetic
atactggctgttgtggtgacaatgacccaattgatgtgtgtgaaattggaagcaaggtatgtgcaagaggtgaaataattggcgtgaaagttctaggcat

SEQ ID NO: 1562 - DNA, 50 bp, Artificial Sequence
  Synthetic
tccaatttcacacacatcaattgggtcattgtcaccacaacagccagtat

SEQ ID NO: 1563 - DNA, 50 bp, Artificial Sequence
  Synthetic
atgcctagaactttcacgccaattatttcacctcttgcacataccttgct

SEQ ID NO: 1564 - DNA, 100 bp, Artificial Sequence
  Synthetic
ccctgacatgcatcttcgtctctccatcctggctttcgatctagaggcagaaaagtgcagaaggaagggaagatcagctatgccgactttgtctggtttt

SEQ ID NO: 1565 - DNA, 50 bp, Artificial Sequence
  Synthetic
ctgcctctagatcgaaagccaggatggagagacgaagatgcatgtcaggg

SEQ ID NO: 1566 - DNA, 50 bp, Artificial Sequence
  Synthetic
aaaaccagacaaagtcggcatagctgatcttcccttccttctgcactttt

SEQ ID NO: 1567 - DNA, 100 bp, Artificial Sequence
  Synthetic
agcagaaggaagcactacagttcgtaaggagatcatcaggaataagatcagagccattgggaagatggcacgggtcttttcaattcttcggcaagaaagt

SEQ ID NO: 1568 - DNA, 48 bp, Artificial Sequence
  Synthetic
tgatcttattcctgatgatctccttacgaactgtagtgcttccttctg

SEQ ID NO: 1569 - DNA, 50 bp, Artificial Sequence
  Synthetic
actttcttgccgaagaattgaaaagacccgtgccatcttcccaatggctc

SEQ ID NO: 1570 - DNA, 100 bp, Artificial Sequence
  Synthetic
caagacccactgatttgccagtgtgcatggaaataatagattagagcagaaactagcagggactgttgtataatcgtgatctactagcagaattgggccc

SEQ ID NO: 1571 - DNA, 50 bp, Artificial Sequence
  Synthetic
tctgctctaatctattatttccatgcacactggcaaatcagtgggtcttg

SEQ ID NO: 1572 - DNA, 48 bp, Artificial Sequence
  Synthetic
gcccaattctgctagtagatcacgattatacaacagtccctgctagtt

SEQ ID NO: 1573 - DNA, 100 bp, Artificial Sequence
  Synthetic
catccctgccaaccaggaacttcttgtgtggtattgtcgggactttgcagaaaggcttcactacccttatcccggagagctgacaatgatgaatctcaca

SEQ ID NO: 1574 - DNA, 50 bp, Artificial Sequence
  Synthetic
ctgcaaagtcccgacaataccacacaagaagttcctggttggcagggatg

SEQ ID NO: 1575 - DNA, 50 bp, Artificial Sequence
  Synthetic
tgtgagattcatcattgtcagctctccgggataagggtagtgaagccttt

SEQ ID NO: 1576 - DNA, 100 bp, Artificial Sequence
  Synthetic
ccacacttccctcggtccctgcccgtttcctcaaattcgggccgtgcgcgccctctggtgtcgcctctcacactttgcagtcatttaccaggattcccgt

SEQ ID NO: 1577 - DNA, 47 bp, Artificial Sequence
  Synthetic
cgcgcacggcccgaatttgaggaaacgggcagggaccgagggaagtg

SEQ ID NO: 1578 - DNA, 50 bp, Artificial Sequence
  Synthetic
acgggaatcctggtaaatgactgcaaagtgtgagaggcgacaccagaggg

SEQ ID NO: 1579 - DNA, 100 bp, Artificial Sequence
  Synthetic
gcatggggaagtttgtcccgctggctggaagcctggcagtgacacgattaagcccaacgtggatgacagcaaggaatatttctccaaacacaattaggct

SEQ ID NO: 1580 - DNA, 40 bp, Artificial Sequence
  Synthetic
taatcgtgtcactgccaggcttccagccagcgggacaaac

SEQ ID NO: 1581 - DNA, 50 bp, Artificial Sequence
  Synthetic
agcctaattgtgtttggagaaatattccttgctgtcatccacgttgggct

SEQ ID NO: 1582 - DNA, 100 bp, Artificial Sequence
  Synthetic
aggaggacttgggccaataaggattccacttctttcagatttgacccatcagatctcaaaggactatggtgtatacctagaggactcaggccacactctt

SEQ ID NO: 1583 - DNA, 50 bp, Artificial Sequence
  Synthetic
gatgggtcaaatctgaaagaagtggaatccttattggcccaagtcctcct

SEQ ID NO: 1584 - DNA, 40 bp, Artificial Sequence
  Synthetic
cctgagtcctctaggtatacaccatagtcctttgagatct

SEQ ID NO: 1585 - DNA, 100 bp, Artificial Sequence
  Synthetic
agtttcctggcctctcaggcaatgctgatgacaccctttctcgaaaattggatgatctgagtctctccagacaaggaacaagttttgccagtgaagaatt

SEQ ID NO: 1586 - DNA, 50 bp, Artificial Sequence
  Synthetic
caattttcgagaaagggtgtcatcagcattgcctgagaggccaggaaact

SEQ ID NO: 1587 - DNA, 50 bp, Artificial Sequence
  Synthetic
aattcttcactggcaaaacttgttccttgtctggagagactcagatcatc

SEQ ID NO: 1588 - DNA, 100 bp, Artificial Sequence
  Synthetic
gcatttggagtcctgctgtatgaaatgttggctgggcaggcaccctttgaaggggaggatgaagatgaactcttccaatccatcatggaacacaacgtag

SEQ ID NO: 1589 - DNA, 50 bp, Artificial Sequence
  Synthetic
tcaaagggtgcctgcccagccaacatttcatacagcaggactccaaatgc

SEQ ID NO: 1590 - DNA, 50 bp, Artificial Sequence
  Synthetic
ctacgttgtgttccatgatggattggaagagttcatcttcatcctcccct

SEQ ID NO: 1591 - DNA, 100 bp, Artificial Sequence
  Synthetic
actgcatcatggagaattttgtagccaccttggctaatgggatgagcctccagccgcctcttgaagaagtaacccccctttgcccttccctgtgtctgcc

SEQ ID NO: 1592 - DNA, 50 bp, Artificial Sequence
  Synthetic
gaggctcatcccattagccaaggtggctacaaaattctccatgatgcagt

SEQ ID NO: 1593 - DNA, 49 bp, Artificial Sequence
  Synthetic
gcagacacagggaagggcaaaggggggttacttcttcaagaggcggctg

SEQ ID NO: 1594 - DNA, 100 bp, Artificial Sequence
  Synthetic
agacctcttgtgccaagagcatcattggcgtgataccctactttccttacagcaagcagtgcaagatgagaaaaagaggctccattgtctctaaattgct

SEQ ID NO: 1595 - DNA, 50 bp, Artificial Sequence
  Synthetic
gtaaggaaagtagggtatcacgccaatgatgctcttggcacaagaggtct

SEQ ID NO: 1596 - DNA, 50 bp, Artificial Sequence
  Synthetic
agcaatttagagacaatggagcctctttttctcatcttgcactgcttgct

SEQ ID NO: 1597 - DNA, 100 bp, Artificial Sequence
  Synthetic
gtaatcaacgcccgcgtgtccaccatctctctgcccaccgcccctccagccactggcacgaagtgcctcatctctggctggggcaacactgcgagctctg

SEQ ID NO: 1598 - DNA, 39 bp, Artificial Sequence
  Synthetic
gctggaggggcggtgggcagagagatggtggacacgcgg

SEQ ID NO: 1599 - DNA, 36 bp, Artificial Sequence
  Synthetic
ttgccccagccagagatgaggcacttcgtgccagtg

SEQ ID NO: 1600 - DNA, 100 bp, Artificial Sequence
  Synthetic
aaaatccaatccctcggtttttctctgtcagtgcagttgctatgttgcagaagatcaacagtatcagtggctggaaaaggtttttggctcttgtccaagg

SEQ ID NO: 1601 - DNA, 50 bp, Artificial Sequence
  Synthetic
ctgcaacatagcaactgcactgacagagaaaaaccgagggattggatttt

SEQ ID NO: 1602 - DNA, 50 bp, Artificial Sequence
  Synthetic
ccttggacaagagccaaaaaccttttccagccactgatactgttgatctt

SEQ ID NO: 1603 - DNA, 100 bp, Artificial Sequence
  Synthetic
tgtggtctgccagctaaaggtgaagatatattcctccaattcaggacccacacgacgggaagacaagttcatgtactttgagttccctcagccgttacct

SEQ ID NO: 1604 - DNA, 50 bp, Artificial Sequence
  Synthetic
tgggtcctgaattggaggaatatatcttcacctttagctggcagaccaca

SEQ ID NO: 1605 - DNA, 50 bp, Artificial Sequence
  Synthetic
aggtaacggctgagggaactcaaagtacatgaacttgtcttcccgtcgtg

SEQ ID NO: 1606 - DNA, 100 bp, Artificial Sequence
  Synthetic
accacaatgagatgacactacacatttgccagaatgatgattattaaaaaagaccaagtattggagaggatgtgaaaaaactggaacctcacacattgac

SEQ ID NO: 1607 - DNA, 50 bp, Artificial Sequence
  Synthetic
tttttaataatcatcattctggcaaatgtgtagtgtcatctcattgtggt

SEQ ID NO: 1608 - DNA, 49 bp, Artificial Sequence
  Synthetic
tcaatgtgtgaggttccagttttttcacatcctctccaatacttggtct

SEQ ID NO: 1609 - DNA, 100 bp, Artificial Sequence
  Synthetic
cgcgggcgccgagatccagatggtcatcttactcattgccacctccctggtggtgctcatctgctccatcccgctcgtggtgcgagtattcgtcaaccag

SEQ ID NO: 1610 - DNA, 42 bp, Artificial Sequence
  Synthetic
ccagggaggtggcaatgagtaagatgaccatctggatctcgg

SEQ ID NO: 1611 - DNA, 50 bp, Artificial Sequence
  Synthetic
ctggttgacgaatactcgcaccacgagcgggatggagcagatgagcacca

SEQ ID NO: 1612 - DNA, 100 bp, Artificial Sequence
  Synthetic
ctgacatttcaagctgaccctgtgatctctgccctgtcttcgggcgacaggagccagaaaatcagggacatggctgatggctgcggatgctggaaccttg

SEQ ID NO: 1613 - DNA, 46 bp, Artificial Sequence
  Synthetic
ctgtcgcccgaagacagggcagagatcacagggtcagcttgaaatg

SEQ ID NO: 1614 - DNA, 35 bp, Artificial Sequence
  Synthetic
cgcagccatcagccatgtccctgattttctggctc

SEQ ID NO: 1615 - DNA, 100 bp, Artificial Sequence
  Synthetic
ggttcaagctggattatttcagtggaactggcaatcggcccagaagaaggaatcagttacctaacggacaagggctgcaatcccacacatcttgctgact

SEQ ID NO: 1616 - DNA, 50 bp, Artificial Sequence
  Synthetic
ccttcttctgggccgattgccagttccactgaaataatccagcttgaacc

SEQ ID NO: 1617 - DNA, 50 bp, Artificial Sequence
  Synthetic
agtcagcaagatgtgtgggattgcagcccttgtccgttaggtaactgatt

SEQ ID NO: 1618 - DNA, 100 bp, Artificial Sequence
  Synthetic
agtgacttcccatgtagagtggccaagcttcctaagaacaaaaaccgaaataggtacagagacgtcagtccctttgaccatagtcggattaaactacatc

SEQ ID NO: 1619 - DNA, 46 bp, Artificial Sequence
  Synthetic
tttcggtttttgttcttaggaagcttggccactctacatgggaagt

SEQ ID NO: 1620 - DNA, 50 bp, Artificial Sequence
  Synthetic
gatgtagtttaatccgactatggtcaaagggactgacgtctctgtaccta

SEQ ID NO: 1621 - DNA, 100 bp, Artificial Sequence
  Synthetic
attggagcgtgtcttgaaggtatctttgtgaaacacaagaatggaaggcatcctgtggtatttaggtggcatgacattgccaacatgtcccacaacaagt

SEQ ID NO: 1622 - DNA, 50 bp, Artificial Sequence
  Synthetic
tgccttccattcttgtgtttcacaaagataccttcaagacacgctccaat

SEQ ID NO: 1623 - DNA, 50 bp, Artificial Sequence
  Synthetic
acttgttgtgggacatgttggcaatgtcatgccacctaaataccacagga

SEQ ID NO: 1624 - DNA, 100 bp, Artificial Sequence
  Synthetic
cttgtaaataccgcaaccgagtatcgatttacttccctaacaccaggccgccaatacaaaattcttgtcttgacgattagcggggatgtacagcagtcag

SEQ ID NO: 1625 - DNA, 50 bp, Artificial Sequence
  Synthetic
cggcctggtgttagggaagtaaatcgatactcggttgcggtatttacaag

SEQ ID NO: 1626 - DNA, 50 bp, Artificial Sequence
  Synthetic
ctgactgctgtacatccccgctaatcgtcaagacaagaattttgtattgg

SEQ ID NO: 1627 - DNA, 100 bp, Artificial Sequence
  Synthetic
cccggcgcaccctgaggcggttcaggcccatgtgctgggctgcttctcccctgctgagcaggagctgctgcctctgttgctggatcgagccaccgacctg

SEQ ID NO: 1628 - DNA, 35 bp, Artificial Sequence
  Synthetic
gggagaagcagcccagcacatgggcctgaaccgcc

SEQ ID NO: 1629 - DNA, 35 bp, Artificial Sequence
  Synthetic
atccagcaacagaggcagcagctcctgctcagcag

SEQ ID NO: 1630 - DNA, 100 bp, Artificial Sequence
  Synthetic
gttaagcggggccttgggcagtgttttcctgctgagggtggttttacattttttttcctcattggcccacagagagtggagttggcctagctctgacgcg

SEQ ID NO: 1631 - DNA, 50 bp, Artificial Sequence
  Synthetic
aatgtaaaaccaccctcagcaggaaaacactgcccaaggccccgcttaac

SEQ ID NO: 1632 - DNA, 50 bp, Artificial Sequence
  Synthetic
cgcgtcagagctaggccaactccactctctgtgggccaatgaggaaaaaa

SEQ ID NO: 1633 - DNA, 100 bp, Artificial Sequence
  Synthetic
gcgactgttgacagagctataaactcaacccgaacacatttgtttgacagccgtcctcgttctccaaatgatttgctggccttgttccggtatccgaggg

SEQ ID NO: 1634 - DNA, 50 bp, Artificial Sequence
  Synthetic
ctgtcaaacaaatgtgttcgggttgagtttatagctctgtcaacagtcgc

SEQ ID NO: 1635 - DNA, 50 bp, Artificial Sequence
  Synthetic
ccctcggataccggaacaaggccagcaaatcatttggagaacgaggacgg

SEQ ID NO: 1636 - DNA, 100 bp, Artificial Sequence
  Synthetic
tagggcagctcagtccctggcctcttagcaccacattcctgtttttcagcttatttgaagtcctgcctcattctcactggagcctcagtctctcctgctt

SEQ ID NO: 1637 - DNA, 50 bp, Artificial Sequence
  Synthetic
gctgaaaaacaggaatgtggtgctaagaggccagggactgagctgcccta

SEQ ID NO: 1638 - DNA, 50 bp, Artificial Sequence
  Synthetic
aagcaggagagactgaggctccagtgagaatgaggcaggacttcaaataa

SEQ ID NO: 1639 - DNA, 100 bp, Artificial Sequence
  Synthetic
cctgtgttcccaagagaattacattattgacaaaagactccaagacgaggatgccagtagtacccagcagaggcgccagatatttagagttaataaagat

SEQ ID NO: 1640 - DNA, 50 bp, Artificial Sequence
  Synthetic
cctcgtcttggagtcttttgtcaataatgtaattctcttgggaacacagg

SEQ ID NO: 1641 - DNA, 50 bp, Artificial Sequence
  Synthetic
atctttattaactctaaatatctggcgcctctgctgggtactactggcat

SEQ ID NO: 1642 - DNA, 100 bp, Artificial Sequence
  Synthetic
agaccggctacaatgtggacctcctgtttgagaccctctttgacctggtggtgccaatgatcttacagcagagagctgagaggccgtcacacacagtgga

SEQ ID NO: 1643 - DNA, 47 bp, Artificial Sequence
  Synthetic
caccaggtcaaagagggtctcaaacaggaggtccacattgtagccgg

SEQ ID NO: 1644 - DNA, 38 bp, Artificial Sequence
  Synthetic
gacggcctctcagctctctgctgtaagatcattggcac

SEQ ID NO: 1645 - DNA, 100 bp, Artificial Sequence
  Synthetic
ttttgtaaagagcttccatctgggctggacccagttcttgcacatacaagacaccgctgcagtcagctaggacctttccgccatgtattctattctgtag

SEQ ID NO: 1646 - DNA, 50 bp, Artificial Sequence
  Synthetic
cttgtatgtgcaagaactgggtccagcccagatggaagctctttacaaaa

SEQ ID NO: 1647 - DNA, 50 bp, Artificial Sequence
  Synthetic
ctacagaatagaatacatggcggaaaggtcctagctgactgcagcggtgt

SEQ ID NO: 1648 - DNA, 100 bp, Artificial Sequence
  Synthetic
gggagaagaccgtggaaatcgagggcgagaagatcaaggttcaggtgtgggacacagcaggtcaggaacgtttccgcaaaagcatggtcgagcattacta

SEQ ID NO: 1649 - DNA, 40 bp, Artificial Sequence
  Synthetic
ccacacctgaaccttgatcttctcgccctcgatttccacg

SEQ ID NO: 1650 - DNA, 50 bp, Artificial Sequence
  Synthetic
tagtaatgctcgaccatgcttttgcggaaacgttcctgacctgctgtgtc

SEQ ID NO: 1651 - DNA, 100 bp, Artificial Sequence
  Synthetic
cgccacagactcgcgctatgggcagaaggagtcctcggatcagaacttcgactacatgttcaagattctcatcatcggcaacagcagcgtgggcaagacg

SEQ ID NO: 1652 - DNA, 40 bp, Artificial Sequence
  Synthetic
cgaagttctgatccgaggactccttctgcccatagcgcga

SEQ ID NO: 1653 - DNA, 50 bp, Artificial Sequence
  Synthetic
cgtcttgcccacgctgctgttgccgatgatgagaatcttgaacatgtagt

SEQ ID NO: 1654 - DNA, 100 bp, Artificial Sequence
  Synthetic
catttgaattgtctcctgactactgtccagtaaggaggcccattgtcacttagaaaagacacctggaacccatgtgcatttctgcatctcctggattagc

SEQ ID NO: 1655 - DNA, 50 bp, Artificial Sequence
  Synthetic
agtgacaatgggcctccttactggacagtagtcaggagacaattcaaatg

SEQ ID NO: 1656 - DNA, 49 bp, Artificial Sequence
  Synthetic
ctaatccaggagatgcagaaatgcacatgggttccaggtgtcttttcta

SEQ ID NO: 1657 - DNA, 100 bp, Artificial Sequence
  Synthetic
ttgaaggatgcattcagtctactagcatattcagatccctggaacagcccagttggaaatcagcttgacccgattcagagagaacctgtgtgctcagctc

SEQ ID NO: 1658 - DNA, 50 bp, Artificial Sequence
  Synthetic
gggctgttccagggatctgaatatgctagtagactgaatgcatccttcaa

SEQ ID NO: 1659 - DNA, 46 bp, Artificial Sequence
  Synthetic
tgagcacacaggttctctctgaatcgggtcaagctgatttccaact

SEQ ID NO: 1660 - DNA, 100 bp, Artificial Sequence
  Synthetic
gcattttgcgtacctcatacaggctccttgcccacactatggaatgacagcagccagtgcagggaggttaagtgacatttaatgagtgaagcacttagca

SEQ ID NO: 1661 - DNA, 50 bp, Artificial Sequence
  Synthetic
ctgtcattccatagtgtgggcaaggagcctgtatgaggtacgcaaaatgc

SEQ ID NO: 1662 - DNA, 50 bp, Artificial Sequence
  Synthetic
tgctaagtgcttcactcattaaatgtcacttaacctccctgcactggctg

SEQ ID NO: 1663 - DNA, 100 bp, Artificial Sequence
  Synthetic
gaaacccgagtgcaaagtcaggcccaatgggaggaaacggaaatgcctggcctgcatcaaactgggctctgaggacaaagttctgggccggttggtccac

SEQ ID NO: 1664 - DNA, 50 bp, Artificial Sequence
  Synthetic
ccaggcatttccgtttcctcccattgggcctgactttgcactcgggtttc

SEQ ID NO: 1665 - DNA, 44 bp, Artificial Sequence
  Synthetic
caaccggcccagaactttgtcctcagagcccagtttgatgcagg

SEQ ID NO: 1666 - DNA, 100 bp, Artificial Sequence
  Synthetic
gctgacttgcatgattatggagatggtctatctgatgctgaaaatgtctctagttttttgacaacggctaaataaccatgggatcaagtggccttgggaa

SEQ ID NO: 1667 - DNA, 50 bp, Artificial Sequence
  Synthetic
gagacattttcagcatcagatagaccatctccataatcatgcaagtcagc

SEQ ID NO: 1668 - DNA, 50 bp, Artificial Sequence
  Synthetic
ttcccaaggccacttgatcccatggttatttagccgttgtcaaaaaacta

SEQ ID NO: 1669 - DNA, 100 bp, Artificial Sequence
  Synthetic
tgaaggaagactgtctgccgagttctcacgtgcccatcagtgacagcaagtccattcagaagtcggagctcttaggcctgctgaaaacctacaactgcta

SEQ ID NO: 1670 - DNA, 44 bp, Artificial Sequence
  Synthetic
cttgctgtcactgatgggcacgtgagaactcggcagacagtctt

SEQ ID NO: 1671 - DNA, 50 bp, Artificial Sequence
  Synthetic
tagcagttgtaggttttcagcaggcctaagagctccgacttctgaatgga

SEQ ID NO: 1672 - DNA, 100 bp, Artificial Sequence
  Synthetic
agatccaataattccctttagtgatggacccatcatctcaaaatggggtgcgatttccagatcttcccgtacaggttaccataccacagatcctgtccag

SEQ ID NO: 1673 - DNA, 50 bp, Artificial Sequence
  Synthetic
caccccattttgagatgatgggtccatcactaaagggaattattggatct

SEQ ID NO: 1674 - DNA, 50 bp, Artificial Sequence
  Synthetic
ctggacaggatctgtggtatggtaacctgtacgggaagatctggaaatcg

SEQ ID NO: 1675 - DNA, 100 bp, Artificial Sequence
  Synthetic
tggtgaatcatttgaactgaagattgtgcgacggggaatgcctcccggaggaggaggcgaagtggttttctcatgtcctgtgaggaaggtcttgaagccc

SEQ ID NO: 1676 - DNA, 50 bp, Artificial Sequence
  Synthetic
ctccgggaggcattccccgtcgcacaatcttcagttcaaatgattcacca

SEQ ID NO: 1677 - DNA, 50 bp, Artificial Sequence
  Synthetic
gggcttcaagaccttcctcacaggacatgagaaaaccacttcgcctcctc

SEQ ID NO: 1678 - DNA, 100 bp, Artificial Sequence
  Synthetic
tggcctccggtgcgtataacccgtatatagagataattgaacaacccaggcagaggggaatgcgttttagatacaaatgtgaagggcgatcagcaggcag

SEQ ID NO: 1679 - DNA, 50 bp, Artificial Sequence
  Synthetic
cctgggttgttcaattatctctatatacgggttatacgcaccggaggcca

SEQ ID NO: 1680 - DNA, 50 bp, Artificial Sequence
  Synthetic
ctgcctgctgatcgcccttcacatttgtatctaaaacgcattcccctctg

SEQ ID NO: 1681 - DNA, 100 bp, Artificial Sequence
  Synthetic
tgacctgacagggaggaggctgagaactcagttttgtgaccatgacagtaatgaaaccagggtcccaaccaagaaatctaactcaaacgtcccacttcat

SEQ ID NO: 1682 - DNA, 40 bp, Artificial Sequence
  Synthetic
tactgtcatggtcacaaaactgagttctcagcctcctccc

SEQ ID NO: 1683 - DNA, 50 bp, Artificial Sequence
  Synthetic
atgaagtgggacgtttgagttagatttcttggttgggaccctggtttcat

SEQ ID NO: 1684 - DNA, 100 bp, Artificial Sequence
  Synthetic
agagccatcctgatcaagaaaaccgacagatctcagaaaactgatcttcacaatgaaggctacatcttggaattagattgctgttcctccttagaccacc

SEQ ID NO: 1685 - DNA, 50 bp, Artificial Sequence
  Synthetic
tgaagatcagttttctgagatctgtcggttttcttgatcaggatggctct

SEQ ID NO: 1686 - DNA, 50 bp, Artificial Sequence
  Synthetic
ggtggtctaaggaggaacagcaatctaattccaagatgtagccttcattg

SEQ ID NO: 1687 - DNA, 100 bp, Artificial Sequence
  Synthetic
agccatgtgaattccacaagaagcaccagggaaagtttagagatttgcggcaatggaccgaagaacgggccaggaagtcctccaatttcctttggtcttt

SEQ ID NO: 1688 - DNA, 50 bp, Artificial Sequence
  Synthetic
ccgcaaatctctaaactttccctggtgcttcttgtggaattcacatggct

SEQ ID NO: 1689 - DNA, 50 bp, Artificial Sequence
  Synthetic
aaagaccaaaggaaattggaggacttcctggcccgttcttcggtccattg

SEQ ID NO: 1690 - DNA, 100 bp, Artificial Sequence
  Synthetic
ggatcaccgatgacacccagttctgggacttaaatgccaaattggtggaaatcccaaccaagatgcgagtggaacgatgggccttcaacttcagcgaatt

SEQ ID NO: 1691 - DNA, 50 bp, Artificial Sequence
  Synthetic
ttccaccaatttggcatttaagtcccagaactgggtgtcatcggtgatcc

SEQ ID NO: 1692 - DNA, 50 bp, Artificial Sequence
  Synthetic
aattcgctgaagttgaaggcccatcgttccactcgcatcttggttgggat

SEQ ID NO: 1693 - DNA, 100 bp, Artificial Sequence
  Synthetic
gacaacttcctctcactgttgcctgcatttgtacgtgagaaacgctcatgacagcaaagtctccttatgtataatgaaacaaggtcagagacagatttga

SEQ ID NO: 1694 - DNA, 50 bp, Artificial Sequence
  Synthetic
catgagcgtttctcacgtacaaatgcaggcaacagtgagaggaagttgtc

SEQ ID NO: 1695 - DNA, 50 bp, Artificial Sequence
  Synthetic
tcaaatctgtctctgaccttgtttcattatacataaggagactttgctgt

SEQ ID NO: 1696 - DNA, 100 bp, Artificial Sequence
  Synthetic
gaagacatctttggcacatcaatttgtggaaggcgagttctcggaaggctacgatcctacagtggagaatacttacagcaagatagtgactcttggcaaa

SEQ ID NO: 1697 - DNA, 50 bp, Artificial Sequence
  Synthetic
agccttccgagaactcgccttccacaaattgatgtgccaaagatgtcttc

SEQ ID NO: 1698 - DNA, 50 bp, Artificial Sequence
  Synthetic
tttgccaagagtcactatcttgctgtaagtattctccactgtaggatcgt

SEQ ID NO: 1699 - DNA, 100 bp, Artificial Sequence
  Synthetic
ctgcggcaagacctcgctgctcatggtgtacagccagggctccttccccgagcactacgccccatcggtgttcgagaagtacacggccagcgtgaccgtt

SEQ ID NO: 1700 - DNA, 38 bp, Artificial Sequence
  Synthetic
cggggaaggagccctggctgtacaccatgagcagcgag

SEQ ID NO: 1701 - DNA, 39 bp, Artificial Sequence
  Synthetic
tggccgtgtacttctcgaacaccgatggggcgtagtgct

SEQ ID NO: 1702 - DNA, 100 bp, Artificial Sequence
  Synthetic
cgccaatgaactacgtgctgacccagacgactgtgtctacatcgtcgtggactagccctagaatgccatccttcttcaggagctagtttggagatgggtt

SEQ ID NO: 1703 - DNA, 45 bp, Artificial Sequence
  Synthetic
ccacgacgatgtagacacagtcgtctgggtcagcacgtagttcat

SEQ ID NO: 1704 - DNA, 50 bp, Artificial Sequence
  Synthetic
aacccatctccaaactagctcctgaagaaggatggcattctagggctagt

SEQ ID NO: 1705 - DNA, 100 bp, Artificial Sequence
  Synthetic
cagttcccgggtacagtcaactgcatttttctctggtgaccaagcttccactgacaaggaagaggattatattcgttatgcccatggtctgatatctgac

SEQ ID NO: 1706 - DNA, 50 bp, Artificial Sequence
  Synthetic
tggaagcttggtcaccagagaaaaatgcagttgactgtacccgggaactg

SEQ ID NO: 1707 - DNA, 50 bp, Artificial Sequence
  Synthetic
gtcagatatcagaccatgggcataacgaatataatcctcttccttgtcag

SEQ ID NO: 1708 - DNA, 100 bp, Artificial Sequence
  Synthetic
aagcttggatttccgacctgtagtgtctccagcaaatggggttgaaggagtccgagtggatcaggatgatgatcaagatagctcttccctgaagctttct

SEQ ID NO: 1709 - DNA, 50 bp, Artificial Sequence
  Synthetic
ctccttcaaccccatttgctggagacactacaggtcggaaatccaagctt

SEQ ID NO: 1710 - DNA, 50 bp, Artificial Sequence
  Synthetic
agaaagcttcagggaagagctatcttgatcatcatcctgatccactcgga

SEQ ID NO: 1711 - DNA, 100 bp, Artificial Sequence
  Synthetic
cctttttggtggagaaaatggattggagtatcgaagcagcagttgctacttttgcccaagccagaccaccaggaatctacaagggtgattatttgaagga

SEQ ID NO: 1712 - DNA, 50 bp, Artificial Sequence
  Synthetic
agtagcaactgctgcttcgatactccaatccattttctccaccaaaaagg

SEQ ID NO: 1713 - DNA, 50 bp, Artificial Sequence
  Synthetic
tccttcaaataatcacccttgtagattcctggtggtctggcttgggcaaa

SEQ ID NO: 1714 - DNA, 100 bp, Artificial Sequence
  Synthetic
tgaaccacaaaaaaaaaggctggtgttcaccaaaaccaaacttgttcatttagataatttgaaaaagttccatagaaaaggcgtgcagtactaagggaac

SEQ ID NO: 1715 - DNA, 50 bp, Artificial Sequence
  Synthetic
aatgaacaagtttggttttggtgaacaccagcctttttttttgtggttca

SEQ ID NO: 1716 - DNA, 50 bp, Artificial Sequence
  Synthetic
gttcccttagtactgcacgccttttctatggaactttttcaaattatcta

SEQ ID NO: 1717 - DNA, 100 bp, Artificial Sequence
  Synthetic
cctgactctcagatctcttcccagagaagtcagctccactgtcgtatgcccaaggctggtgcttctcctgtagattactcctgaaccgtgtccctgagac

SEQ ID NO: 1718 - DNA, 45 bp, Artificial Sequence
  Synthetic
ggcatacgacagtggagctgacttctctgggaagagatctgagag

SEQ ID NO: 1719 - DNA, 46 bp, Artificial Sequence
  Synthetic
cagggacacggttcaggagtaatctacaggagaagcaccagccttg

SEQ ID NO: 1720 - DNA, 100 bp, Artificial Sequence
  Synthetic
agatgccactttgaagaacccaatcctctggaatgtggctgatgtggtcatcaagttccctgaggaagaagctccctcgactgtcttgtcccagaacctt

SEQ ID NO: 1721 - DNA, 50 bp, Artificial Sequence
  Synthetic
tgaccacatcagccacattccagaggattgggttcttcaaagtggcatct

SEQ ID NO: 1722 - DNA, 50 bp, Artificial Sequence
  Synthetic
aaggttctgggacaagacagtcgagggagcttcttcctcagggaacttga

SEQ ID NO: 1723 - DNA, 100 bp, Artificial Sequence
  Synthetic
gtggaactattgaatacatggcaccagatattgtcagagggggagattcaggacatgacaaggcagttgactggtggagtttgggtgttctaatgtatga

SEQ ID NO: 1724 - DNA, 50 bp, Artificial Sequence
  Synthetic
tgaatctccccctctgacaatatctggtgccatgtattcaatagttccac

SEQ ID NO: 1725 - DNA, 50 bp, Artificial Sequence
  Synthetic
tcatacattagaacacccaaactccaccagtcaactgccttgtcatgtcc

SEQ ID NO: 1726 - DNA, 100 bp, Artificial Sequence
  Synthetic
caacaggaagcgcctctccaaactcatcaagaaattccaagacctttctgaaggaagcagtatatctcaactcagttttgcggaggacatttctgctgat

SEQ ID NO: 1727 - DNA, 50 bp, Artificial Sequence
  Synthetic
cagaaaggtcttggaatttcttgatgagtttggagaggcgcttcctgttg

SEQ ID NO: 1728 - DNA, 50 bp, Artificial Sequence
  Synthetic
atcagcagaaatgtcctccgcaaaactgagttgagatatactgcttcctt

SEQ ID NO: 1729 - DNA, 100 bp, Artificial Sequence
  Synthetic
aggaagctggtatggagaagatcaacttttcaggtggagagccatttcttcaagaccggggagaatacctgggcaagttggtgaggttctgcaaagtaga

SEQ ID NO: 1730 - DNA, 50 bp, Artificial Sequence
  Synthetic
aagaaatggctctccacctgaaaagttgatcttctccataccagcttcct

SEQ ID NO: 1731 - DNA, 50 bp, Artificial Sequence
  Synthetic
tctactttgcagaacctcaccaacttgcccaggtattctccccggtcttg

SEQ ID NO: 1732 - DNA, 100 bp, Artificial Sequence
  Synthetic
agcgtggctgtgtgactaagatatatggaagagctttcgttgctggtgttttgccatttaaagtagcaaaagatatggcagcggcagcagttagatgcat

SEQ ID NO: 1733 - DNA, 50 bp, Artificial Sequence
  Synthetic
aacaccagcaacgaaagctcttccatatatcttagtcacacagccacgct

SEQ ID NO: 1734 - DNA, 50 bp, Artificial Sequence
  Synthetic
atgcatctaactgctgccgctgccatatcttttgctactttaaatggcaa

SEQ ID NO: 1735 - DNA, 100 bp, Artificial Sequence
  Synthetic
cctgcgtgcccgggcctgtccctcctgaccccaggattatagtggcgaggcagggtgttagccaagcggattgagccaggacacagcaccgcggagccct

SEQ ID NO: 1736 - DNA, 37 bp, Artificial Sequence
  Synthetic
cctcgccactataatcctggggtcaggagggacaggc

SEQ ID NO: 1737 - DNA, 38 bp, Artificial Sequence
  Synthetic
tgctgtgtcctggctcaatccgcttggctaacaccctg

SEQ ID NO: 1738 - DNA, 100 bp, Artificial Sequence
  Synthetic
tacaaatgtaattttatccctcatgtatacttggatatggcggggggagggctgggactgtttcgtttctgcttctagagattgaggtgaaagcttcgtc

SEQ ID NO: 1739 - DNA, 50 bp, Artificial Sequence
  Synthetic
cctccccccgccatatccaagtatacatgagggataaaattacatttgta

SEQ ID NO: 1740 - DNA, 50 bp, Artificial Sequence
  Synthetic
gacgaagctttcacctcaatctctagaagcagaaacgaaacagtcccagc

SEQ ID NO: 1741 - DNA, 100 bp, Artificial Sequence
  Synthetic
ggggtctgcctggaatagcactgaatgtgtttagtagtgcctttggcttgggggctttggagaaagctgcttgagcccttcccatgctcataaattaggt

SEQ ID NO: 1742 - DNA, 50 bp, Artificial Sequence
  Synthetic
caagccaaaggcactactaaacacattcagtgctattccaggcagacccc

SEQ ID NO: 1743 - DNA, 50 bp, Artificial Sequence
  Synthetic
acctaatttatgagcatgggaagggctcaagcagctttctccaaagcccc

SEQ ID NO: 1744 - DNA, 100 bp, Artificial Sequence
  Synthetic
tcccgccaggtggcctcggccttcatcgtcatcctctgttgcgccattgtggtggaaaaccttctggtgctcattgcggtggcccgaaacagcaagttcc

SEQ ID NO: 1745 - DNA, 45 bp, Artificial Sequence
  Synthetic
acaatggcgcaacagaggatgacgatgaaggccgaggccacctgg

SEQ ID NO: 1746 - DNA, 50 bp, Artificial Sequence
  Synthetic
ggaacttgctgtttcgggccaccgcaatgagcaccagaaggttttccacc

SEQ ID NO: 1747 - DNA, 100 bp, Artificial Sequence
  Synthetic
agcttcttttcgttccttggcgaggcttttgatggggctcgggacatgtggagagcctactctgacatgagagaagccaattacatcggctcagacaaat

SEQ ID NO: 1748 - DNA, 50 bp, Artificial Sequence
  Synthetic
cacatgtcccgagccccatcaaaagcctcgccaaggaacgaaaagaagct

SEQ ID NO: 1749 - DNA, 50 bp, Artificial Sequence
  Synthetic
atttgtctgagccgatgtaattggcttctctcatgtcagagtaggctctc

SEQ ID NO: 1750 - DNA, 100 bp, Artificial Sequence
  Synthetic
ttgagtcttttagggcagatgcagacacagtgctgctctttctgaaaagtgtgcaggatgtttccttatatgtccgagaggctgacggaacagagaaact

SEQ ID NO: 1751 - DNA, 50 bp, Artificial Sequence
  Synthetic
acttttcagaaagagcagcactgtgtctgcatctgccctaaaagactcaa

SEQ ID NO: 1752 - DNA, 48 bp, Artificial Sequence
  Synthetic
tttctctgttccgtcagcctctcggacatataaggaaacatcctgcac

SEQ ID NO: 1753 - DNA, 100 bp, Artificial Sequence
  Synthetic
ctaccagttgccttttcagacctgaggctctaactcaagagattcctcctctccctcaccattcctgccaccattttttctgggtgatgcagcaagagtt

SEQ ID NO: 1754 - DNA, 49 bp, Artificial Sequence
  Synthetic
aggaggaatctcttgagttagagcctcaggtctgaaaaggcaactggta

SEQ ID NO: 1755 - DNA, 50 bp, Artificial Sequence
  Synthetic
aactcttgctgcatcacccagaaaaaatggtggcaggaatggtgagggag

SEQ ID NO: 1756 - DNA, 100 bp, Artificial Sequence
  Synthetic
attcaggaccattctgtggccgtgccagagtgcatacggatttcacgccaagtccctatgacactgactccctcaaaatcaagaaaggagacatcataga

SEQ ID NO: 1757 - DNA, 50 bp, Artificial Sequence
  Synthetic
tggcgtgaaatccgtatgcactctggcacggccacagaatggtcctgaat

SEQ ID NO: 1758 - DNA, 50 bp, Artificial Sequence
  Synthetic
tctatgatgtctcctttcttgattttgagggagtcagtgtcatagggact

SEQ ID NO: 1759 - DNA, 100 bp, Artificial Sequence
  Synthetic
acaagtaaatacacttaggagatacaaaagacacttcaagctaccaaccagaccaggacttaataaagcacaacttgttgagatagttggttgccacttt

SEQ ID NO: 1760 - DNA, 50 bp, Artificial Sequence
  Synthetic
tggttggtagcttgaagtgtcttttgtatctcctaagtgtatttacttgt

SEQ ID NO: 1761 - DNA, 50 bp, Artificial Sequence
  Synthetic
aaagtggcaaccaactatctcaacaagttgtgctttattaagtcctggtc

SEQ ID NO: 1762 - DNA, 100 bp, Artificial Sequence
  Synthetic
cagccttacctccaggtagcacttaattggtccattcacctagactgcaagtaagaagacaaaatgactgagaccgtgtgcccacctgaacttattgtct

SEQ ID NO: 1763 - DNA, 50 bp, Artificial Sequence
  Synthetic
ttgcagtctaggtgaatggaccaattaagtgctacctggaggtaaggctg

SEQ ID NO: 1764 - DNA, 50 bp, Artificial Sequence
  Synthetic
agacaataagttcaggtgggcacacggtctcagtcattttgtcttcttac

SEQ ID NO: 1765 - DNA, 100 bp, Artificial Sequence
  Synthetic
tgaaattctcctggaggtcggtaggttcagccaaggttttataaggctgatgtcaatttctgtgttgccaagctccaagccccatcttctaaatggcaaa

SEQ ID NO: 1766 - DNA, 50 bp, Artificial Sequence
  Synthetic
tcagccttataaaaccttggctgaacctaccgacctccaggagaatttca

SEQ ID NO: 1767 - DNA, 50 bp, Artificial Sequence
  Synthetic
tttgccatttagaagatggggcttggagcttggcaacacagaaattgaca

SEQ ID NO: 1768 - DNA, 100 bp, Artificial Sequence
  Synthetic
ccggaaacatgcacaattcttggattacaacaggtgaagattctggggtgggcgaaacctccaaaagaccattttcccatgacaatgcagattttggcaa

SEQ ID NO: 1769 - DNA, 50 bp, Artificial Sequence
  Synthetic
caccccagaatcttcacctgttgtaatccaagaattgtgcatgtttccgg

SEQ ID NO: 1770 - DNA, 50 bp, Artificial Sequence
  Synthetic
ttgccaaaatctgcattgtcatgggaaaatggtcttttggaggtttcgcc

SEQ ID NO: 1771 - DNA, 100 bp, Artificial Sequence
  Synthetic
tactccattattgcaaggccaacctctgtgggattctgtactttgttgactctaatgagatgtacggcacaccttctgtatttcttacggaagagggcta

SEQ ID NO: 1772 - DNA, 50 bp, Artificial Sequence
  Synthetic
gtcaacaaagtacagaatcccacagaggttggccttgcaataatggagta

SEQ ID NO: 1773 - DNA, 50 bp, Artificial Sequence
  Synthetic
tagccctcttccgtaagaaatacagaaggtgtgccgtacatctcattaga

SEQ ID NO: 1774 - DNA, 100 bp, Artificial Sequence
  Synthetic
cccacagttcatcaaagccaccatcgtgcaccaagaccaggcttacgatgacaagatctactacttcttccgagaggacaatcctgacaagaatcctgag

SEQ ID NO: 1775 - DNA, 46 bp, Artificial Sequence
  Synthetic
catcgtaagcctggtcttggtgcacgatggtggctttgatgaactg

SEQ ID NO: 1776 - DNA, 49 bp, Artificial Sequence
  Synthetic
tcaggattcttgtcaggattgtcctctcggaagaagtagtagatcttgt

SEQ ID NO: 1777 - DNA, 100 bp, Artificial Sequence
  Synthetic
tgcccatcttcgtgagagaaaaagcagcacatcctgcccatttctggtgctttctgctcacaggcaccaaagctgcacatgtaaactgacttcttgccaa

SEQ ID NO: 1778 - DNA, 47 bp, Artificial Sequence
  Synthetic
gcaccagaaatgggcaggatgtgctgctttttctctcacgaagatgg

SEQ ID NO: 1779 - DNA, 50 bp, Artificial Sequence
  Synthetic
ttggcaagaagtcagtttacatgtgcagctttggtgcctgtgagcagaaa

SEQ ID NO: 1780 - DNA, 100 bp, Artificial Sequence
  Synthetic
ccaaagggcgctggttggtagggtgaggtgggggagtattttaatttttggaatttgggaagcagacagctttactttgtaaggttggaacagcagcact

SEQ ID NO: 1781 - DNA, 50 bp, Artificial Sequence
  Synthetic
caaaaattaaaatactcccccacctcaccctaccaaccagcgccctttgg

SEQ ID NO: 1782 - DNA, 50 bp, Artificial Sequence
  Synthetic
agtgctgctgttccaaccttacaaagtaaagctgtctgcttcccaaattc

SEQ ID NO: 1783 - DNA, 100 bp, Artificial Sequence
  Synthetic
ccactaaatcctaggtgggaaatggcctgttaactgatggcacattgctaatgcacaagaaataacaaaccacatccctctttctgttctgagggtgcat

SEQ ID NO: 1784 - DNA, 47 bp, Artificial Sequence
  Synthetic
tagcaatgtgccatcagttaacaggccatttcccacctaggatttag

SEQ ID NO: 1785 - DNA, 50 bp, Artificial Sequence
  Synthetic
atgcaccctcagaacagaaagagggatgtggtttgttatttcttgtgcat

SEQ ID NO: 1786 - DNA, 100 bp, Artificial Sequence
  Synthetic
ttacactctcaactccgacctcgcccgcctaggtgtgcaggatctctttaacagtagcaaggctgatctgtctggcatgtcaggagccagagatattttt

SEQ ID NO: 1787 - DNA, 43 bp, Artificial Sequence
  Synthetic
taaagagatcctgcacacctaggcgggcgaggtcggagttgag

SEQ ID NO: 1788 - DNA, 50 bp, Artificial Sequence
  Synthetic
aaaaatatctctggctcctgacatgccagacagatcagccttgctactgt

SEQ ID NO: 1789 - DNA, 100 bp, Artificial Sequence
  Synthetic
tgggcctggccctgaacttttccgtcttccactacgagatcgccaacagccccgaggaggccatctctctggccaagaccactttcgacgaggccatggc

SEQ ID NO: 1790 - DNA, 47 bp, Artificial Sequence
  Synthetic
gctgttggcgatctcgtagtggaagacggaaaagttcagggccaggc

SEQ ID NO: 1791 - DNA, 38 bp, Artificial Sequence
  Synthetic
tcgaaagtggtcttggccagagagatggcctcctcggg

SEQ ID NO: 1792 - DNA, 100 bp, Artificial Sequence
  Synthetic
ggaggtggtggtggcataggttatgaagctaatcctggcgttccaccagcaaccatgagtggttccatgatgggaagtgacatgcgtactgagcgctttg

SEQ ID NO: 1793 - DNA, 44 bp, Artificial Sequence
  Synthetic
gctggtggaacgccaggattagcttcataacctatgccaccacc

SEQ ID NO: 1794 - DNA, 50 bp, Artificial Sequence
  Synthetic
caaagcgctcagtacgcatgtcacttcccatcatggaaccactcatggtt

SEQ ID NO: 1795 - DNA, 100 bp, Artificial Sequence
  Synthetic
gtgtgaaccgtcgtgtgagtgtggtatgcctgatcacagatggattttgttataagcatcaatgtgacacttgcaggacactacaacgtgggacattgtt

SEQ ID NO: 1796 - DNA, 50 bp, Artificial Sequence
  Synthetic
acaaaatccatctgtgatcaggcataccacactcacacgacggttcacac

SEQ ID NO: 1797 - DNA, 50 bp, Artificial Sequence
  Synthetic
aacaatgtcccacgttgtagtgtcctgcaagtgtcacattgatgcttata

SEQ ID NO: 1798 - DNA, 100 bp, Artificial Sequence
  Synthetic
agacctccatagatccttctccagagagccatgaagtaatggaaagaatacttgacagcgttcagggaaagtctactgtatctgaacaagctgataagga

SEQ ID NO: 1799 - DNA, 48 bp, Artificial Sequence
  Synthetic
tattctttccattacttcatggctctctggagaaggatctatggaggt

SEQ ID NO: 1800 - DNA, 50 bp, Artificial Sequence
  Synthetic
tccttatcagcttgttcagatacagtagactttccctgaacgctgtcaag

SEQ ID NO: 1801 - DNA, 100 bp, Artificial Sequence
  Synthetic
gctgtatcacggttacatttatacataccgagtgtcccagacagaaacaggttcttggagtgctgagacagcacctggggtacataaaagatatttccgg

SEQ ID NO: 1802 - DNA, 50 bp, Artificial Sequence
  Synthetic
ctgtttctgtctgggacactcggtatgtataaatgtaaccgtgatacagc

SEQ ID NO: 1803 - DNA, 50 bp, Artificial Sequence
  Synthetic
ccggaaatatcttttatgtaccccaggtgctgtctcagcactccaagaac

SEQ ID NO: 1804 - DNA, 100 bp, Artificial Sequence
  Synthetic
agctcttgggctggtttttcagagcagagttcttgttgtgggtagactgtgactaggttcacagcctttgtggaacattccgtataacggcattgtggaa

SEQ ID NO: 1805 - DNA, 50 bp, Artificial Sequence
  Synthetic
acagtctacccacaacaagaactctgctctgaaaaaccagcccaagagct

SEQ ID NO: 1806 - DNA, 50 bp, Artificial Sequence
  Synthetic
ttccacaatgccgttatacggaatgttccacaaaggctgtgaacctagtc

SEQ ID NO: 1807 - DNA, 100 bp, Artificial Sequence
  Synthetic
ggtcatcatggtcaccgtccttggagtggtgtttggaaaaaatgacgtatggttctgggtcatcttctctgcaatccacgttctggcctcgctagccctc

SEQ ID NO: 1808 - DNA, 50 bp, Artificial Sequence
  Synthetic
atacgtcattttttccaaacaccactccaaggacggtgaccatgatgacc

SEQ ID NO: 1809 - DNA, 47 bp, Artificial Sequence
  Synthetic
ggctagcgaggccagaacgtggattgcagagaagatgacccagaacc

SEQ ID NO: 1810 - DNA, 100 bp, Artificial Sequence
  Synthetic
ccagggcaagcagatgtcgcaagccctatttattcagtcttcactataactcttagagttgagacgctaatgttcatgactcctggccttgggatgccca

SEQ ID NO: 1811 - DNA, 50 bp, Artificial Sequence
  Synthetic
gttatagtgaagactgaataaatagggcttgcgacatctgcttgccctgg

SEQ ID NO: 1812 - DNA, 47 bp, Artificial Sequence
  Synthetic
gcatcccaaggccaggagtcatgaacattagcgtctcaactctaaga

SEQ ID NO: 1813 - DNA, 100 bp, Artificial Sequence
  Synthetic
acaattggttttcagggcccagtccaagcctgctgctggaaacctcagagttaaatccctattctccacacctctcacctccaccacccctccctgtccc

SEQ ID NO: 1814 - DNA, 50 bp, Artificial Sequence
  Synthetic
ctctgaggtttccagcagcaggcttggactgggccctgaaaaccaattgt

SEQ ID NO: 1815 - DNA, 48 bp, Artificial Sequence
  Synthetic
gacagggaggggtggtggaggtgagaggtgtggagaatagggatttaa

SEQ ID NO: 1816 - DNA, 100 bp, Artificial Sequence
  Synthetic
gtgtgatttctgatgaagggggctggtggaaagctatttctcttagcactggtcgagagagttacatccctggaatatgtgtggccagagtttaccatgg

SEQ ID NO: 1817 - DNA, 50 bp, Artificial Sequence
  Synthetic
agtgctaagagaaatagctttccaccagcccccttcatcagaaatcacac

SEQ ID NO: 1818 - DNA, 50 bp, Artificial Sequence
  Synthetic
ccatggtaaactctggccacacatattccagggatgtaactctctcgacc

SEQ ID NO: 1819 - DNA, 100 bp, Artificial Sequence
  Synthetic
gtgtctcttgatccatccgaagcaggccctccacgttatctaggagatcgctacaagttttatctggagaatctcaccctggggatacgggaaagcagga

SEQ ID NO: 1820 - DNA, 50 bp, Artificial Sequence
  Synthetic
cgatctcctagataacgtggagggcctgcttcggatggatcaagagacac

SEQ ID NO: 1821 - DNA, 50 bp, Artificial Sequence
  Synthetic
tcctgctttcccgtatccccagggtgagattctccagataaaacttgtag

SEQ ID NO: 1822 - DNA, 100 bp, Artificial Sequence
  Synthetic
gaacaacacgctgcccgattacagcccgggggaatcttttttcactgtctttggggttttcttcccagcggctacaggagtcatggccggcttcaacatg

SEQ ID NO: 1823 - DNA, 50 bp, Artificial Sequence
  Synthetic
agacagtgaaaaaagattcccccgggctgtaatcgggcagcgtgttgttc

SEQ ID NO: 1824 - DNA, 50 bp, Artificial Sequence
  Synthetic
catgttgaagccggccatgactcctgtagccgctgggaagaaaaccccaa

SEQ ID NO: 1825 - DNA, 100 bp, Artificial Sequence
  Synthetic
ttacctcactgaagtactcgcatgttgtttggtacccactgagcaactgtttcagttcctaaggtatttgctgagatgtgggtgaactccaaatggagaa

SEQ ID NO: 1826 - DNA, 50 bp, Artificial Sequence
  Synthetic
acagttgctcagtgggtaccaaacaacatgcgagtacttcagtgaggtaa

SEQ ID NO: 1827 - DNA, 50 bp, Artificial Sequence
  Synthetic
ttctccatttggagttcacccacatctcagcaaataccttaggaactgaa

SEQ ID NO: 1828 - DNA, 100 bp, Artificial Sequence
  Synthetic
tttttccaattacctgctgacacggttctaagctaagtgaaggggaagatctgagagcgtgctgtttgtggctgttgatgcatattcgtgatgtaacagg

SEQ ID NO: 1829 - DNA, 50 bp, Artificial Sequence
  Synthetic
atcttccccttcacttagcttagaaccgtgtcagcaggtaattggaaaaa

SEQ ID NO: 1830 - DNA, 50 bp, Artificial Sequence
  Synthetic
cctgttacatcacgaatatgcatcaacagccacaaacagcacgctctcag

SEQ ID NO: 1831 - DNA, 100 bp, Artificial Sequence
  Synthetic
ttgacatcaaactctatggcgtggccttatcgattgcagtgggaagttgttgaagacttgaagacgtgattcctgctccaatcatcccttcttgctcctc

SEQ ID NO: 1832 - DNA, 50 bp, Artificial Sequence
  Synthetic
acaacttcccactgcaatcgataaggccacgccatagagtttgatgtcaa

SEQ ID NO: 1833 - DNA, 50 bp, Artificial Sequence
  Synthetic
gaggagcaagaagggatgattggagcaggaatcacgtcttcaagtcttca

SEQ ID NO: 1834 - DNA, 100 bp, Artificial Sequence
  Synthetic
cggtgactttcagcgtcgccagcaccgtgaaacatgccttgtccatctggctcagcgtaatcgttttcggcaacaagatcaccagcttgtcggccgttgg

SEQ ID NO: 1835 - DNA, 50 bp, Artificial Sequence
  Synthetic
ccagatggacaaggcatgtttcacggtgctggcgacgctgaaagtcaccg

SEQ ID NO: 1836 - DNA, 50 bp, Artificial Sequence
  Synthetic
ccaacggccgacaagctggtgatcttgttgccgaaaacgattacgctgag

SEQ ID NO: 1837 - DNA, 100 bp, Artificial Sequence
  Synthetic
acgacatgtggccatagctctgatcctgcttgttttggtcaatgtccttgtcatctgtgtgccaaccatccgggatatctttggagttatcgggtccacc

SEQ ID NO: 1838 - DNA, 50 bp, Artificial Sequence
  Synthetic
caaggacattgaccaaaacaagcaggatcagagctatggccacatgtcgt

SEQ ID NO: 1839 - DNA, 50 bp, Artificial Sequence
  Synthetic
ggtggacccgataactccaaagatatcccggatggttggcacacagatga

SEQ ID NO: 1840 - DNA, 100 bp, Artificial Sequence
  Synthetic
ccttgcatgtacttgaaggatggatgagtcagacacgattgagaactgacaaaggagccttgataatacttgacctctgtgaccaactgttggattcaga

SEQ ID NO: 1841 - DNA, 45 bp, Artificial Sequence
  Synthetic
gtcagttctcaatcgtgtctgactcatccatccttcaagtacatg

SEQ ID NO: 1842 - DNA, 50 bp, Artificial Sequence
  Synthetic
tctgaatccaacagttggtcacagaggtcaagtattatcaaggctccttt

SEQ ID NO: 1843 - DNA, 100 bp, Artificial Sequence
  Synthetic
agcagaaatccaagcaccaccaaacacagtgtatgaaggggggcggtcatcatttcacttgtcaggagtgtgtgtgagtgtgagtgtgcggctgtgtgtg

SEQ ID NO: 1844 - DNA, 48 bp, Artificial Sequence
  Synthetic
atgaccgccccccttcatacactgtgtttggtggtgcttggatttctg

SEQ ID NO: 1845 - DNA, 50 bp, Artificial Sequence
  Synthetic
cacacacagccgcacactcacactcacacacactcctgacaagtgaaatg

SEQ ID NO: 1846 - DNA, 100 bp, Artificial Sequence
  Synthetic
gccctgtcctggcatcagtagcatctgtaacagcattaactgtcttaaagagagagagagagaattccgaattggggaacacacgatacctgtttttctt

SEQ ID NO: 1847 - DNA, 50 bp, Artificial Sequence
  Synthetic
ctttaagacagttaatgctgttacagatgctactgatgccaggacagggc

SEQ ID NO: 1848 - DNA, 50 bp, Artificial Sequence
  Synthetic
aagaaaaacaggtatcgtgtgttccccaattcggaattctctctctctct

SEQ ID NO: 1849 - DNA, 100 bp, Artificial Sequence
  Synthetic
gttgagggaaggacaagagataagaggttgttacctcagtaaaaaccttcaggccacaaagcaaaaagttgcatagccacaacgaagatctagttggata

SEQ ID NO: 1850 - DNA, 50 bp, Artificial Sequence
  Synthetic
gaaggtttttactgaggtaacaacctcttatctcttgtccttccctcaac

SEQ ID NO: 1851 - DNA, 46 bp, Artificial Sequence
  Synthetic
caactagatcttcgttgtggctatgcaactttttgctttgtggcct

SEQ ID NO: 1852 - DNA, 100 bp, Artificial Sequence
  Synthetic
ggcaggggtctctcatgtgtgtccatctgcgtgtatgtcaaggaagtgagatgccaatttggggtcttgaggctgaccagttggggtgcttgggtgatct

SEQ ID NO: 1853 - DNA, 50 bp, Artificial Sequence
  Synthetic
ctcacttccttgacatacacgcagatggacacacatgagagacccctgcc

SEQ ID NO: 1854 - DNA, 42 bp, Artificial Sequence
  Synthetic
caagcaccccaactggtcagcctcaagaccccaaattggcat

SEQ ID NO: 1855 - DNA, 100 bp, Artificial Sequence
  Synthetic
tgggaggagatcatgctgtgcctttggaccctggtcagttagaaacagttttggaaaagtgagctctgggttctgctctgagatggtcagagaagatgcg

SEQ ID NO: 1856 - DNA, 48 bp, Artificial Sequence
  Synthetic
aactgtttctaactgaccagggtccaaaggcacagcatgatctcctcc

SEQ ID NO: 1857 - DNA, 50 bp, Artificial Sequence
  Synthetic
cgcatcttctctgaccatctcagagcagaacccagagctcacttttccaa

SEQ ID NO: 1858 - DNA, 100 bp, Artificial Sequence
  Synthetic
aggacttaattacccagtgcccagttgtgccacattcccactcaaggctcagaacttggctcgcattggtagctggaggtggtagaatttgtatgctctt

SEQ ID NO: 1859 - DNA, 47 bp, Artificial Sequence
  Synthetic
gagccttgagtgggaatgtggcacaactgggcactgggtaattaagt

SEQ ID NO: 1860 - DNA, 50 bp, Artificial Sequence
  Synthetic
aagagcatacaaattctaccacctccagctaccaatgcgagccaagttct

SEQ ID NO: 1861 - DNA, 100 bp, Artificial Sequence
  Synthetic
actgcattttccaccaacagtcattagacacctggcactgtcacagctcacttttccagagggatattcctgtggctttggcaaggagccattagtgatg

SEQ ID NO: 1862 - DNA, 50 bp, Artificial Sequence
  Synthetic
tgagctgtgacagtgccaggtgtctaatgactgttggtggaaaatgcagt

SEQ ID NO: 1863 - DNA, 50 bp, Artificial Sequence
  Synthetic
catcactaatggctccttgccaaagccacaggaatatccctctggaaaag

SEQ ID NO: 1864 - DNA, 100 bp, Artificial Sequence
  Synthetic
ttaactgtatctggagccaggacctgaactcgcacctcctacctcttcatgtttacatatacccagtatctttgcacaaaccaggggttgggggagggtc

SEQ ID NO: 1865 - DNA, 35 bp, Artificial Sequence
  Synthetic
atgaagaggtaggaggtgcgagttcaggtcctggc

SEQ ID NO: 1866 - DNA, 50 bp, Artificial Sequence
  Synthetic
gaccctcccccaacccctggtttgtgcaaagatactgggtatatgtaaac

SEQ ID NO: 1867 - DNA, 100 bp, Artificial Sequence
  Synthetic
ggaacggcactgttcacctttatctgaccaaaccgctctacacgtcagcaccatctctgcagcatctctgtaggctcaccattaacaaatgtaccggtgc

SEQ ID NO: 1868 - DNA, 50 bp, Artificial Sequence
  Synthetic
tgctgacgtgtagagcggtttggtcagataaaggtgaacagtgccgttcc

SEQ ID NO: 1869 - DNA, 50 bp, Artificial Sequence
  Synthetic
gcaccggtacatttgttaatggtgagcctacagagatgctgcagagatgg

SEQ ID NO: 1870 - DNA, 100 bp, Artificial Sequence
  Synthetic
ggaggatggaggagacgggacatctttcacctcaggctcctggtagagaagacaggggattctactctgtgcctcctgactatgtctggctaagagattc

SEQ ID NO: 1871 - DNA, 37 bp, Artificial Sequence
  Synthetic
ttctctaccaggagcctgaggtgaaagatgtcccgtc

SEQ ID NO: 1872 - DNA, 35 bp, Artificial Sequence
  Synthetic
acatagtcaggaggcacagagtagaatcccctgtc

SEQ ID NO: 1873 - DNA, 100 bp, Artificial Sequence
  Synthetic
cctctcttagatcctgagtgagacaaatacagaaatgacccattccctgcccaccagaaactcagaggtgattggggagactgacacaggaaaatgaact

SEQ ID NO: 1874 - DNA, 50 bp, Artificial Sequence
  Synthetic
gcagggaatgggtcatttctgtatttgtctcactcaggatctaagagagg

SEQ ID NO: 1875 - DNA, 48 bp, Artificial Sequence
  Synthetic
ttcattttcctgtgtcagtctccccaatcacctctgagtttctggtgg

SEQ ID NO: 1876 - DNA, 100 bp, Artificial Sequence
  Synthetic
ctaagcattgacagaatatcttaaaatggtaacctgggggtggcgggtgggtgctgtgtgcacggcagcctagccagtggggatcctgctgtttattata

SEQ ID NO: 1877 - DNA, 50 bp, Artificial Sequence
  Synthetic
ccacccgccacccccaggttaccattttaagatattctgtcaatgcttag

SEQ ID NO: 1878 - DNA, 50 bp, Artificial Sequence
  Synthetic
tataataaacagcaggatccccactggctaggctgccgtgcacacagcac

SEQ ID NO: 1879 - DNA, 100 bp, Artificial Sequence
  Synthetic
tagccatgcaatgatggatttcaatctgagtggagattctgatggaagtgctggagtctcagagtcaagaatttatagggaatcccgagggcgtggtagc

SEQ ID NO: 1880 - DNA, 50 bp, Artificial Sequence
  Synthetic
cacttccatcagaatctccactcagattgaaatccatcattgcatggcta

SEQ ID NO: 1881 - DNA, 48 bp, Artificial Sequence
  Synthetic
taccacgccctcgggattccctataaattcttgactctgagactccag

SEQ ID NO: 1882 - DNA, 100 bp, Artificial Sequence
  Synthetic
aacaagacatgatatttgaggcccgtttagataccatggcagagacaaacagcatatctttaaatggacctttgagaacagacgatctggtgagagagga

SEQ ID NO: 1883 - DNA, 50 bp, Artificial Sequence
  Synthetic
gtttgtctctgccatggtatctaaacgggcctcaaatatcatgtcttgtt

SEQ ID NO: 1884 - DNA, 50 bp, Artificial Sequence
  Synthetic
tcctctctcaccagatcgtctgttctcaaaggtccatttaaagatatgct

SEQ ID NO: 1885 - DNA, 100 bp, Artificial Sequence
  Synthetic
ttttcgagacctgtgacctggacaatgacaagtacatcgccctggatgagtgggccggctgcttcggcatcaagcagaaggatatcgacaaggatcttgt

SEQ ID NO: 1886 - DNA, 50 bp, Artificial Sequence
  Synthetic
ctcatccagggcgatgtacttgtcattgtccaggtcacaggtctcgaaaa

SEQ ID NO: 1887 - DNA, 37 bp, Artificial Sequence
  Synthetic
cgatatccttctgcttgatgccgaagcagccggccca

SEQ ID NO: 1888 - DNA, 100 bp, Artificial Sequence
  Synthetic
ttgaccaacaccctatggatagagtcttgacacattctgaacttgctcctctgcgagcatctctggtgcccatggaacactgcataacccgtttctttga

SEQ ID NO: 1889 - DNA, 50 bp, Artificial Sequence
  Synthetic
aggagcaagttcagaatgtgtcaagactctatccatagggtgttggtcaa

SEQ ID NO: 1890 - DNA, 50 bp, Artificial Sequence
  Synthetic
tcaaagaaacgggttatgcagtgttccatgggcaccagagatgctcgcag

SEQ ID NO: 1891 - DNA, 100 bp, Artificial Sequence
  Synthetic
gtccaaaccaaatgtctggacaccatgattcaaaccgccaggttaccatgaggaggatttctggccttcgaggaaatgctccaaggctggaattttctac

SEQ ID NO: 1892 - DNA, 50 bp, Artificial Sequence
  Synthetic
catggtaacctggcggtttgaatcatggtgtccagacatttggtttggac

SEQ ID NO: 1893 - DNA, 50 bp, Artificial Sequence
  Synthetic
gtagaaaattccagccttggagcatttcctcgaaggccagaaatcctcct

SEQ ID NO: 1894 - DNA, 100 bp, Artificial Sequence
  Synthetic
ccacttgagcctcttccacaaattcccaacttgcctttctgggtgaaggagaaggccaacagtttgaaaaatgagatacaagaggttgaggagcttgaca

SEQ ID NO: 1895 - DNA, 50 bp, Artificial Sequence
  Synthetic
tccttcacccagaaaggcaagttgggaatttgtggaagaggctcaagtgg

SEQ ID NO: 1896 - DNA, 48 bp, Artificial Sequence
  Synthetic
tcaagctcctcaacctcttgtatctcatttttcaaactgttggccttc

SEQ ID NO: 1897 - DNA, 100 bp, Artificial Sequence
  Synthetic
ctttgtcatgtacagactccctgggatcctcatgttttgggtgacaggacctatggaccactatactcggggaggcagggtagcagttcttccagaatcc

SEQ ID NO: 1898 - DNA, 50 bp, Artificial Sequence
  Synthetic
gtcctgtcacccaaaacatgaggatcccagggagtctgtacatgacaaag

SEQ ID NO: 1899 - DNA, 41 bp, Artificial Sequence
  Synthetic
aagaactgctaccctgcctccccgagtatagtggtccatag

SEQ ID NO: 1900 - DNA, 100 bp, Artificial Sequence
  Synthetic
cctggcagtcaccttcgcagcctctctgatccctcaatttggtctgttttcaaaatatagaacgccaaactgctctcagtatagattaccaggatgtccc

SEQ ID NO: 1901 - DNA, 50 bp, Artificial Sequence
  Synthetic
aaaacagaccaaattgagggatcagagaggctgcgaaggtgactgccagg

SEQ ID NO: 1902 - DNA, 50 bp, Artificial Sequence
  Synthetic
gggacatcctggtaatctatactgagagcagtttggcgttctatattttg

SEQ ID NO: 1903 - DNA, 100 bp, Artificial Sequence
  Synthetic
cagatgccgggcctccatgcctaggtggtggtacaatgtcactgacggatcctgccagctgtttgtgtatgggggctgtgacggaaacagcaataattac

SEQ ID NO: 1904 - DNA, 40 bp, Artificial Sequence
  Synthetic
atccgtcagtgacattgtaccaccacctaggcatggaggc

SEQ ID NO: 1905 - DNA, 50 bp, Artificial Sequence
  Synthetic
gtaattattgctgtttccgtcacagcccccatacacaaacagctggcagg

SEQ ID NO: 1906 - DNA, 100 bp, Artificial Sequence
  Synthetic
gattccacatttgatggggtgactgacaaacccatcttagactgctgtgcctgcggaactgccaagtacagactcacattttatgggaattggtccgaga

SEQ ID NO: 1907 - DNA, 50 bp, Artificial Sequence
  Synthetic
gcacagcagtctaagatgggtttgtcagtcaccccatcaaatgtggaatc

SEQ ID NO: 1908 - DNA, 50 bp, Artificial Sequence
  Synthetic
tctcggaccaattcccataaaatgtgagtctgtacttggcagttccgcag

SEQ ID NO: 1909 - DNA, 100 bp, Artificial Sequence
  Synthetic
tgtcgctagcaagcatctggttcagcggaaatgggatgtgagaatgatgaaacccgacagaagtatctcagcctgcagtcagttattatgtataggaggt

SEQ ID NO: 1910 - DNA, 50 bp, Artificial Sequence
  Synthetic
tcatcattctcacatcccatttccgctgaaccagatgcttgctagcgaca

SEQ ID NO: 1911 - DNA, 50 bp, Artificial Sequence
  Synthetic
acctcctatacataataactgactgcaggctgagatacttctgtcgggtt

SEQ ID NO: 1912 - DNA, 100 bp, Artificial Sequence
  Synthetic
ggatgacttgaagggttccttgaaagaggacctgacacagcacaagttcatttgtgaacagtgtgggaagtgcaagtgtggagaatgcactgctcccagg

SEQ ID NO: 1913 - DNA, 50 bp, Artificial Sequence
  Synthetic
tgaacttgtgctgtgtcaggtcctctttcaaggaacccttcaagtcatcc

SEQ ID NO: 1914 - DNA, 49 bp, Artificial Sequence
  Synthetic
ctgggagcagtgcattctccacacttgcacttcccacactgttcacaaa

SEQ ID NO: 1915 - DNA, 100 bp, Artificial Sequence
  Synthetic
gggcctttttgaggttctagtggagaagtatgagtggtcgcaggaagaggcagctggcttcacagatttcttactgcccatgttggagctgatccctgag

SEQ ID NO: 1916 - DNA, 50 bp, Artificial Sequence
  Synthetic
cctcttcctgcgaccactcatacttctccactagaacctcaaaaaggccc

SEQ ID NO: 1917 - DNA, 48 bp, Artificial Sequence
  Synthetic
cagggatcagctccaacatgggcagtaagaaatctgtgaagccagctg

SEQ ID NO: 1918 - DNA, 100 bp, Artificial Sequence
  Synthetic
gtatggtgctagtggataagcatggcatggacaaagagcgctatgtctccctggtgatgcctgtggccctgttcaacctgattgacacttttcccttgag

SEQ ID NO: 1919 - DNA, 42 bp, Artificial Sequence
  Synthetic
ggagacatagcgctctttgtccatgccatgcttatccactag

SEQ ID NO: 1920 - DNA, 50 bp, Artificial Sequence
  Synthetic
ctcaagggaaaagtgtcaatcaggttgaacagggccacaggcatcaccag

SEQ ID NO: 1921 - DNA, 100 bp, Artificial Sequence
  Synthetic
gagagggctcactggatcccaatccttggagctggatcattggattcaaatcataatgtggataggatagggaggatgaattaccaggattcatggagcg

SEQ ID NO: 1922 - DNA, 50 bp, Artificial Sequence
  Synthetic
tttgaatccaatgatccagctccaaggattgggatccagtgagccctctc

SEQ ID NO: 1923 - DNA, 50 bp, Artificial Sequence
  Synthetic
cgctccatgaatcctggtaattcatcctccctatcctatccacattatga

SEQ ID NO: 1924 - DNA, 100 bp, Artificial Sequence
  Synthetic
ggatccaactcgacaacaaggacatccaaatatgggtgggccaatgcagagaatgactcctccaagaggaatggtgcccttaggaccacagaactatgga

SEQ ID NO: 1925 - DNA, 50 bp, Artificial Sequence
  Synthetic
tctgcattggcccacccatatttggatgtccttgttgtcgagttggatcc

SEQ ID NO: 1926 - DNA, 38 bp, Artificial Sequence
  Synthetic
tggtcctaagggcaccattcctcttggaggagtcattc

SEQ ID NO: 1927 - DNA, 100 bp, Artificial Sequence
  Synthetic
tctcctctaaaccacgaaagagtaagatttgtgcaaccctcctcctcttccacctccttcaggagaattaaatgaatcaagactttggaaagacggggaa

SEQ ID NO: 1928 - DNA, 50 bp, Artificial Sequence
  Synthetic
gaagaggaggagggttgcacaaatcttactctttcgtggtttagaggaga

SEQ ID NO: 1929 - DNA, 50 bp, Artificial Sequence
  Synthetic
ttccccgtctttccaaagtcttgattcatttaattctcctgaaggaggtg

SEQ ID NO: 1930 - DNA, 100 bp, Artificial Sequence
  Synthetic
agggactcaaaccatacctcagaggggaatggcgactctttgttagctgatgaagacactgactttgaagacagcttgaatcgcaatgtgaagaagagag

SEQ ID NO: 1931 - DNA, 45 bp, Artificial Sequence
  Synthetic
tcagctaacaaagagtcgccattcccctctgaggtatggtttgag

SEQ ID NO: 1932 - DNA, 48 bp, Artificial Sequence
  Synthetic
ctcttcttcacattgcgattcaagctgtcttcaaagtcagtgtcttca

SEQ ID NO: 1933 - DNA, 100 bp, Artificial Sequence
  Synthetic
atgctggcatgcttgaggtttctgcttgtaaaaaaaagggctttcatccacacaccaaggagcccaggctgttcagtatatgcaaacatgtgttggtaaa

SEQ ID NO: 1934 - DNA, 50 bp, Artificial Sequence
  Synthetic
tggatgaaagcccttttttttacaagcagaaacctcaagcatgccagcat

SEQ ID NO: 1935 - DNA, 50 bp, Artificial Sequence
  Synthetic
tttaccaacacatgtttgcatatactgaacagcctgggctccttggtgtg

SEQ ID NO: 1936 - DNA, 100 bp, Artificial Sequence
  Synthetic
gaacccttctttgggaaatatgatcctgaggcctggtagtgacagtagaaactactccatcactattcggcaggagatagacattccaagaatcaagcac

SEQ ID NO: 1937 - DNA, 50 bp, Artificial Sequence
  Synthetic
ttctactgtcactaccaggcctcaggatcatatttcccaaagaagggttc

SEQ ID NO: 1938 - DNA, 50 bp, Artificial Sequence
  Synthetic
gtgcttgattcttggaatgtctatctcctgccgaatagtgatggagtagt

SEQ ID NO: 1939 - DNA, 100 bp, Artificial Sequence
  Synthetic
tttgctgtatgccatcctcgagagctgtctaggttaacgttcgcactctgtgtatataacctcgacagtcttggcacctaacgtgctgtgcgtagctgct

SEQ ID NO: 1940 - DNA, 50 bp, Artificial Sequence
  Synthetic
cagagtgcgaacgttaacctagacagctctcgaggatggcatacagcaaa

SEQ ID NO: 1941 - DNA, 50 bp, Artificial Sequence
  Synthetic
agcagctacgcacagcacgttaggtgccaagactgtcgaggttatataca

SEQ ID NO: 1942 - DNA, 100 bp, Artificial Sequence
  Synthetic
agacttgggcttaccattgggtttaaatcatagggacctagggcgagggttcagggcttctctggagcagatattgtcaagttcatggccttaggtagca

SEQ ID NO: 1943 - DNA, 47 bp, Artificial Sequence
  Synthetic
accctcgccctaggtccctatgatttaaacccaatggtaagcccaag

SEQ ID NO: 1944 - DNA, 50 bp, Artificial Sequence
  Synthetic
tgctacctaaggccatgaacttgacaatatctgctccagagaagccctga

SEQ ID NO: 1945 - DNA, 100 bp, Artificial Sequence
  Synthetic
gatgcctggattgagcatgatgtttggagaatggagatttatgtgtctctgggaattgtgggattggcaatactggctctgttggctgtgacatctattc

SEQ ID NO: 1946 - DNA, 50 bp, Artificial Sequence
  Synthetic
agagacacataaatctccattctccaaacatcatgctcaatccaggcatc

SEQ ID NO: 1947 - DNA, 50 bp, Artificial Sequence
  Synthetic
gaatagatgtcacagccaacagagccagtattgccaatcccacaattccc

SEQ ID NO: 1948 - DNA, 100 bp, Artificial Sequence
  Synthetic
ctttcaggatggaaaaggcactagaagaagcaaatgccctccaagaaggtcattctgtgcctgaaattaattcggataccgacaaatcagaaaccgagga

SEQ ID NO: 1949 - DNA, 50 bp, Artificial Sequence
  Synthetic
accttcttggagggcatttgcttcttctagtgccttttccatcctgaaag

SEQ ID NO: 1950 - DNA, 50 bp, Artificial Sequence
  Synthetic
tcctcggtttctgatttgtcggtatccgaattaatttcaggcacagaatg

SEQ ID NO: 1951 - DNA, 100 bp, Artificial Sequence
  Synthetic
ccagacttggcttggatgactttgagtctctgaaagttataggaagaggagcttttggagaggtgcggttggtccagaagaaagatacaggccatatcta

SEQ ID NO: 1952 - DNA, 50 bp, Artificial Sequence
  Synthetic
tcctcttcctataactttcagagactcaaagtcatccaagccaagtctgg

SEQ ID NO: 1953 - DNA, 50 bp, Artificial Sequence
  Synthetic
tagatatggcctgtatctttcttctggaccaaccgcacctctccaaaagc

SEQ ID NO: 1954 - DNA, 100 bp, Artificial Sequence
  Synthetic
cgtgggtggcggcaggactttccttatcccagttgattgtgcagaatacactgcctgtcgcttgtcttctattcaccatggcttcttctgatatccaggt

SEQ ID NO: 1955 - DNA, 50 bp, Artificial Sequence
  Synthetic
tgtattctgcacaatcaactgggataaggaaagtcctgccgccacccacg

SEQ ID NO: 1956 - DNA, 50 bp, Artificial Sequence
  Synthetic
acctggatatcagaagaagccatggtgaatagaagacaagcgacaggcag

SEQ ID NO: 1957 - DNA, 100 bp, Artificial Sequence
  Synthetic
gacccagctgtagtgaggttgcagtgattgagtaggattggcctgcttcaaagcagaggtttctcatgggaatatgcttattaaactcccactggtgcag

SEQ ID NO: 1958 - DNA, 47 bp, Artificial Sequence
  Synthetic
tgaagcaggccaatcctactcaatcactgcaacctcactacagctgg

SEQ ID NO: 1959 - DNA, 50 bp, Artificial Sequence
  Synthetic
ctgcaccagtgggagtttaataagcatattcccatgagaaacctctgctt

SEQ ID NO: 1960 - DNA, 100 bp, Artificial Sequence
  Synthetic
tgacaccttgcactcttaccgtcttgacagaagccaagtaaggaactgaagttgtatctgactgtagggtgaatgtctgaggcctgcctcctaataaaga

SEQ ID NO: 1961 - DNA, 47 bp, Artificial Sequence
  Synthetic
ttcagttccttacttggcttctgtcaagacggtaagagtgcaaggtg

SEQ ID NO: 1962 - DNA, 48 bp, Artificial Sequence
  Synthetic
tttattaggaggcaggcctcagacattcaccctacagtcagatacaac

SEQ ID NO: 1963 - DNA, 100 bp, Artificial Sequence
  Synthetic
ggtgcctcttcctgcccgtatctttctcttccaagggcagtgctccaaggcagggactggagaagccaaggggagagtctaaaagggctagagcattttt

SEQ ID NO: 1964 - DNA, 50 bp, Artificial Sequence
  Synthetic
ccttggagcactgcccttggaagagaaagatacgggcaggaagaggcacc

SEQ ID NO: 1965 - DNA, 50 bp, Artificial Sequence
  Synthetic
aaaaatgctctagcccttttagactctccccttggcttctccagtccctg

SEQ ID NO: 1966 - DNA, 100 bp, Artificial Sequence
  Synthetic
tccagaaatcaggagacggagacattttgtcagttttgcaacattggaccaaatacaatgaagtattcttgctgtgctctggttttggctgtcctgggca

SEQ ID NO: 1967 - DNA, 50 bp, Artificial Sequence
  Synthetic
ggtccaatgttgcaaaactgacaaaatgtctccgtctcctgatttctgga

SEQ ID NO: 1968 - DNA, 50 bp, Artificial Sequence
  Synthetic
tgcccaggacagccaaaaccagagcacagcaagaatacttcattgtattt

SEQ ID NO: 1969 - DNA, 100 bp, Artificial Sequence
  Synthetic
gatggaagccatgtccgatgagcaaaaaatggcccagaaaataatgaagatgatacacggagattacatcgaaaagccagactttgccctgaagtctata

SEQ ID NO: 1970 - DNA, 45 bp, Artificial Sequence
  Synthetic
tcttcattattttctgggccattttttgctcatcggacatggctt

SEQ ID NO: 1971 - DNA, 50 bp, Artificial Sequence
  Synthetic
tatagacttcagggcaaagtctggcttttcgatgtaatctccgtgtatca

SEQ ID NO: 1972 - DNA, 100 bp, Artificial Sequence
  Synthetic
gcattgttcgtaccaccgagatcaagcagcagtcaggtgtctgcggtgaaacctcagaccctgggaggcgattccactttcttcaagagtttcaacaaat

SEQ ID NO: 1973 - DNA, 49 bp, Artificial Sequence
  Synthetic
ttcaccgcagacacctgactgctgcttgatctcggtggtacgaacaatg

SEQ ID NO: 1974 - DNA, 50 bp, Artificial Sequence
  Synthetic
atttgttgaaactcttgaagaaagtggaatcgcctcccagggtctgaggt

SEQ ID NO: 1975 - DNA, 100 bp, Artificial Sequence
  Synthetic
cggactctccaaagcactgcgtgctgatgaaaactactacaaggcccagacccatggaaagtggcctgtcaagtggtacgctccggaatgcatcaactac

SEQ ID NO: 1976 - DNA, 50 bp, Artificial Sequence
  Synthetic
tctgggccttgtagtagttttcatcagcacgcagtgctttggagagtccg

SEQ ID NO: 1977 - DNA, 50 bp, Artificial Sequence
  Synthetic
gtagttgatgcattccggagcgtaccacttgacaggccactttccatggg

SEQ ID NO: 1978 - DNA, 100 bp, Artificial Sequence
  Synthetic
ggtcctcgagtggattgcttctatctttgcttttgccacctgtggaggttttaagggccaaacagaaattcaagtgaattgtcctcctgcagttactgag

SEQ ID NO: 1979 - DNA, 50 bp, Artificial Sequence
  Synthetic
aacctccacaggtggcaaaagcaaagatagaagcaatccactcgaggacc

SEQ ID NO: 1980 - DNA, 50 bp, Artificial Sequence
  Synthetic
ctcagtaactgcaggaggacaattcacttgaatttctgtttggcccttaa

SEQ ID NO: 1981 - DNA, 100 bp, Artificial Sequence
  Synthetic
ctgctcctgaccgtggtggattttgataagttctcccgccactgtgtcattgggaaagtttctgtgcctttgtgtgaagttgacctggtcaagggcgggc

SEQ ID NO: 1982 - DNA, 50 bp, Artificial Sequence
  Synthetic
atgacacagtggcgggagaacttatcaaaatccaccacggtcaggagcag

SEQ ID NO: 1983 - DNA, 48 bp, Artificial Sequence
  Synthetic
ccgcccttgaccaggtcaacttcacacaaaggcacagaaactttccca

SEQ ID NO: 1984 - DNA, 100 bp, Artificial Sequence
  Synthetic
gccggagctgggttgcgatcttcccggagccggagaccctcccttgaaaccggcactgggacttctcgatctctggaggcacctgttgcaagtgacagag

SEQ ID NO: 1985 - DNA, 39 bp, Artificial Sequence
  Synthetic
gtttcaagggagggtctccggctccgggaagatcgcaac

SEQ ID NO: 1986 - DNA, 38 bp, Artificial Sequence
  Synthetic
caacaggtgcctccagagatcgagaagtcccagtgccg

SEQ ID NO: 1987 - DNA, 100 bp, Artificial Sequence
  Synthetic
ccctcgccaggtaatggtagttccagtgggaccaacctgtgatgaatatgcccaaaaggtacgacaacaattccacgatgccaaattcatggcagacatt

SEQ ID NO: 1988 - DNA, 46 bp, Artificial Sequence
  Synthetic
catattcatcacaggttggtcccactggaactaccattacctggcg

SEQ ID NO: 1989 - DNA, 50 bp, Artificial Sequence
  Synthetic
aatgtctgccatgaatttggcatcgtggaattgttgtcgtaccttttggg

SEQ ID NO: 1990 - DNA, 100 bp, Artificial Sequence
  Synthetic
aaaaaaccacacctaaaatagaccactgaggagaccatagagcggatgctttcatgcaccctttactgcactttctgaccaggagctactttgagtttgg

SEQ ID NO: 1991 - DNA, 50 bp, Artificial Sequence
  Synthetic
agcatccgctctatggtctcctcagtggtctattttaggtgtggtttttt

SEQ ID NO: 1992 - DNA, 50 bp, Artificial Sequence
  Synthetic
ccaaactcaaagtagctcctggtcagaaagtgcagtaaagggtgcatgaa

SEQ ID NO: 1993 - DNA, 100 bp, Artificial Sequence
  Synthetic
tgagctgcattttttggagaggcggcccctgtccccaaagctggtgcaagccctgggtgtagcaggccagtgccttgcagtgcaattgtacctgaggacc

SEQ ID NO: 1994 - DNA, 46 bp, Artificial Sequence
  Synthetic
cttgcaccagctttggggacaggggccgcctctccaaaaaatgcag

SEQ ID NO: 1995 - DNA, 40 bp, Artificial Sequence
  Synthetic
tacaattgcactgcaaggcactggcctgctacacccaggg

SEQ ID NO: 1996 - DNA, 100 bp, Artificial Sequence
  Synthetic
accaataaagacagcacactgcctcccattcctcacctccactccttgctcagcgatgatgtggaaccttaccctgaggtagacatctttagactcatca

SEQ ID NO: 1997 - DNA, 48 bp, Artificial Sequence
  Synthetic
agcaaggagtggaggtgaggaatgggaggcagtgtgctgtctttattg

SEQ ID NO: 1998 - DNA, 50 bp, Artificial Sequence
  Synthetic
tgatgagtctaaagatgtctacctcagggtaaggttccacatcatcgctg

SEQ ID NO: 1999 - DNA, 100 bp, Artificial Sequence
  Synthetic
atacgtgtcaacacagctggctggatgattgggactttaaaacgaccctctttcaggtggattcagagacctgtcctgtatataacagcactgtagcaat

SEQ ID NO: 2000 - DNA, 50 bp, Artificial Sequence
  Synthetic
gagggtcgttttaaagtcccaatcatccagccagctgtgttgacacgtat

SEQ ID NO: 2001 - DNA, 50 bp, Artificial Sequence
  Synthetic
attgctacagtgctgttatatacaggacaggtctctgaatccacctgaaa

SEQ ID NO: 2002 - DNA, 100 bp, Artificial Sequence
  Synthetic
ttaggggaagctcggctgccctagtaacaaaaccagcaaacgtcctgatgacaacgaagtgatgacattagccattccttagggtaggaggaacagatgg

SEQ ID NO: 2003 - DNA, 50 bp, Artificial Sequence
  Synthetic
catcaggacgtttgctggttttgttactagggcagccgagcttcccctaa

SEQ ID NO: 2004 - DNA, 50 bp, Artificial Sequence
  Synthetic
ccatctgttcctcctaccctaaggaatggctaatgtcatcacttcgttgt

SEQ ID NO: 2005 - DNA, 100 bp, Artificial Sequence
  Synthetic
aggtattgtgggcatatgtaggtctcctgtccaacccgcaagctcatgtatcaggagttcgattcctataccagtgccagtctatacaggattctcagca

SEQ ID NO: 2006 - DNA, 50 bp, Artificial Sequence
  Synthetic
tacatgagcttgcgggttggacaggagacctacatatgcccacaatacct

SEQ ID NO: 2007 - DNA, 50 bp, Artificial Sequence
  Synthetic
tgctgagaatcctgtatagactggcactggtataggaatcgaactcctga

SEQ ID NO: 2008 - DNA, 100 bp, Artificial Sequence
  Synthetic
ccagaagagggctaagatacgttttctgtcttgagctgaaagcacagtctactctccttcgttttgtcgatgagaaagttgaggccagaggggaggtgac

SEQ ID NO: 2009 - DNA, 50 bp, Artificial Sequence
  Synthetic
agactgtgctttcagctcaagacagaaaacgtatcttagccctcttctgg

SEQ ID NO: 2010 - DNA, 49 bp, Artificial Sequence
  Synthetic
tcacctcccctctggcctcaactttctcatcgacaaaacgaaggagagt

SEQ ID NO: 2011 - DNA, 100 bp, Artificial Sequence
  Synthetic
cgagttcgaggagaggcaatcaggatacgaaccatgaagatgcgtcaacaagcttccttcctaccagctactttaactatgactgtggacaagggagata

SEQ ID NO: 2012 - DNA, 50 bp, Artificial Sequence
  Synthetic
tgttgacgcatcttcatggttcgtatcctgattgcctctcctcgaactcg

SEQ ID NO: 2013 - DNA, 50 bp, Artificial Sequence
  Synthetic
tatctcccttgtccacagtcatagttaaagtagctggtaggaaggaagct

SEQ ID NO: 2014 - DNA, 100 bp, Artificial Sequence
  Synthetic
ggcttcaaggctgggaggaacatgcgtcgcaaactctttggggtcttgcggctgaagtgtcacagcctgtttctggatttgcaggtgaacagcctccaga

SEQ ID NO: 2015 - DNA, 50 bp, Artificial Sequence
  Synthetic
cgcaagaccccaaagagtttgcgacgcatgttcctcccagccttgaagcc

SEQ ID NO: 2016 - DNA, 50 bp, Artificial Sequence
  Synthetic
tctggaggctgttcacctgcaaatccagaaacaggctgtgacacttcagc

SEQ ID NO: 2017 - DNA, 100 bp, Artificial Sequence
  Synthetic
acctggacccgacctcctcgccttggaggaagaatataagcgtttaaatgcagaattgcaggcaaaaacagctgacgtggttcaacaagctaaggaaata

SEQ ID NO: 2018 - DNA, 48 bp, Artificial Sequence
  Synthetic
catttaaacgcttatattcttcctccaaggcgaggaggtcgggtccag

SEQ ID NO: 2019 - DNA, 50 bp, Artificial Sequence
  Synthetic
tatttccttagcttgttgaaccacgtcagctgtttttgcctgcaattctg

SEQ ID NO: 2020 - DNA, 100 bp, Artificial Sequence
  Synthetic
gaccttcttggttaaatcagggactacttctgaactctacccaatcagtttcaaatttagacctgaccactggtgccaccttaccccagtcaagtgtaaa

SEQ ID NO: 2021 - DNA, 50 bp, Artificial Sequence
  Synthetic
aactgattgggtagagttcagaagtagtccctgatttaaccaagaaggtc

SEQ ID NO: 2022 - DNA, 50 bp, Artificial Sequence
  Synthetic
tttacacttgactggggtaaggtggcaccagtggtcaggtctaaatttga

SEQ ID NO: 2023 - DNA, 100 bp, Artificial Sequence
  Synthetic
tttaatccaagatacagaacctgtgatgctttcacctatactggctgtggagggaatgacaataactttgttagcagggaggattgcaaacgtgcatgtg

SEQ ID NO: 2024 - DNA, 50 bp, Artificial Sequence
  Synthetic
ccacagccagtataggtgaaagcatcacaggttctgtatcttggattaaa

SEQ ID NO: 2025 - DNA, 50 bp, Artificial Sequence
  Synthetic
cacatgcacgtttgcaatcctccctgctaacaaagttattgtcattccct

SEQ ID NO: 2026 - DNA, 100 bp, Artificial Sequence
  Synthetic
ggggaaatacgacttagtgaggcatagacatccctggtccatcctttctgtctccagctgtttcttggaacctgctctcctgcttgctggtccctgacgc

SEQ ID NO: 2027 - DNA, 50 bp, Artificial Sequence
  Synthetic
cagaaaggatggaccagggatgtctatgcctcactaagtcgtatttcccc

SEQ ID NO: 2028 - DNA, 45 bp, Artificial Sequence
  Synthetic
agggaccagcaagcaggagagcaggttccaagaaacagctggaga

SEQ ID NO: 2029 - DNA, 100 bp, Artificial Sequence
  Synthetic
aaacatccttgcaaatgggtgtgacgcggttccagatgtggatttggcaaaacctcatttaagtaaaaggttagcagagcaaagtgcggtgctttagctg

SEQ ID NO: 2030 - DNA, 50 bp, Artificial Sequence
  Synthetic
ttgccaaatccacatctggaaccgcgtcacacccatttgcaaggatgttt

SEQ ID NO: 2031 - DNA, 50 bp, Artificial Sequence
  Synthetic
cagctaaagcaccgcactttgctctgctaaccttttacttaaatgaggtt

SEQ ID NO: 2032 - DNA, 100 bp, Artificial Sequence
  Synthetic
cctggggatcatggaaagaaaactccgaatccagccaatcagtatcagtttgataaagttggcatcctgactttgagcgactatgtacttgagctaggtc

SEQ ID NO: 2033 - DNA, 50 bp, Artificial Sequence
  Synthetic
aactgatactgattggctggattcggagttttctttccatgatccccagg

SEQ ID NO: 2034 - DNA, 50 bp, Artificial Sequence
  Synthetic
gacctagctcaagtacatagtcgctcaaagtcaggatgccaactttatca

SEQ ID NO: 2035 - DNA, 100 bp, Artificial Sequence
  Synthetic
cctgcctagtggaccagagccttcgtctggactgccgccatgagaataccagcagttcacccatccagtacgagttcagcctgacccgtgagacaaagaa

SEQ ID NO: 2036 - DNA, 35 bp, Artificial Sequence
  Synthetic
ggtattctcatggcggcagtccagacgaaggctct

SEQ ID NO: 2037 - DNA, 50 bp, Artificial Sequence
  Synthetic
ttctttgtctcacgggtcaggctgaactcgtactggatgggtgaactgct

SEQ ID NO: 2038 - DNA, 100 bp, Artificial Sequence
  Synthetic
ttgcctggggatgagagggagagacaacgtgtgtcttacacatctcccaacagccgacttagatgtgatccgttctcccagagggagcaggtttctttga

SEQ ID NO: 2039 - DNA, 42 bp, Artificial Sequence
  Synthetic
ttgggagatgtgtaagacacacgttgtctctccctctcatcc

SEQ ID NO: 2040 - DNA, 50 bp, Artificial Sequence
  Synthetic
tcaaagaaacctgctccctctgggagaacggatcacatctaagtcggctg

SEQ ID NO: 2041 - DNA, 100 bp, Artificial Sequence
  Synthetic
tattccccacttgtatatcccctaccagtaccgggatctgcacacatctttttgcagttacctcttcatagccatgaaccaaaacgttctatgaggagca

SEQ ID NO: 2042 - DNA, 50 bp, Artificial Sequence
  Synthetic
aagatgtgtgcagatcccggtactggtaggggatatacaagtggggaata

SEQ ID NO: 2043 - DNA, 50 bp, Artificial Sequence
  Synthetic
tgctcctcatagaacgttttggttcatggctatgaagaggtaactgcaaa

SEQ ID NO: 2044 - DNA, 100 bp, Artificial Sequence
  Synthetic
agccaatgatagctggtttggcagcttaaaggacactattcagcatcagcaaggagaagcggtttgggtctctgaaggaaagatggaagggatggatgat

SEQ ID NO: 2045 - DNA, 50 bp, Artificial Sequence
  Synthetic
gctgatgctgaatagtgtcctttaagctgccaaaccagctatcattggct

SEQ ID NO: 2046 - DNA, 50 bp, Artificial Sequence
  Synthetic
atcatccatcccttccatctttccttcagagacccaaaccgcttctcctt

SEQ ID NO: 2047 - DNA, 100 bp, Artificial Sequence
  Synthetic
ggatggcctggattcacgccctcttgtttccttttgggctcaaagcccttcctacctctggtgatggtttccacaggaacaacagcatctttcaccaaga

SEQ ID NO: 2048 - DNA, 50 bp, Artificial Sequence
  Synthetic
aagggctttgagcccaaaaggaaacaagagggcgtgaatccaggccatcc

SEQ ID NO: 2049 - DNA, 50 bp, Artificial Sequence
  Synthetic
tcttggtgaaagatgctgttgttcctgtggaaaccatcaccagaggtagg

SEQ ID NO: 2050 - DNA, 100 bp, Artificial Sequence
  Synthetic
aaaacaaggacagcagaggagggtttgcagagacctccctctgaaaaacacaaagaatggactctctcctgggatgaggacttgctttctttacctccgg

SEQ ID NO: 2051 - DNA, 50 bp, Artificial Sequence
  Synthetic
tgtttttcagagggaggtctctgcaaaccctcctctgctgtccttgtttt

SEQ ID NO: 2052 - DNA, 50 bp, Artificial Sequence
  Synthetic
ccggaggtaaagaaagcaagtcctcatcccaggagagagtccattctttg

SEQ ID NO: 2053 - DNA, 100 bp, Artificial Sequence
  Synthetic
ccacgcgtccgcgggttcccagaaagtagcttgatgagtgtccaaagtagcagtggaagtttggaggggccgccatcttggtcccagctctccacgtctc

SEQ ID NO: 2054 - DNA, 50 bp, Artificial Sequence
  Synthetic
ctactttggacactcatcaagctactttctgggaacccgcggacgcgtgg

SEQ ID NO: 2055 - DNA, 36 bp, Artificial Sequence
  Synthetic
tgggaccaagatggcggcccctccaaacttccactg

SEQ ID NO: 2056 - DNA, 100 bp, Artificial Sequence
  Synthetic
tgtgggcaccacacaggtggttgctgcttcagtgcttcctgctctttttccttgggcctgcttctgggttccatagggaaacagtaagaaagaaagacac

SEQ ID NO: 2057 - DNA, 50 bp, Artificial Sequence
  Synthetic
gaaaaagagcaggaagcactgaagcagcaaccacctgtgtggtgcccaca

SEQ ID NO: 2058 - DNA, 50 bp, Artificial Sequence
  Synthetic
gtgtctttctttcttactgtttccctatggaacccagaagcaggcccaag

SEQ ID NO: 2059 - DNA, 100 bp, Artificial Sequence
  Synthetic
aatcgcagtatttaagaggtagcaggaatgggctgagagtggtgtttgctttctccaccagaagggcacactttcatctaatttggggtatcactgagct

SEQ ID NO: 2060 - DNA, 50 bp, Artificial Sequence
  Synthetic
agcaaacaccactctcagcccattcctgctacctcttaaatactgcgatt

SEQ ID NO: 2061 - DNA, 50 bp, Artificial Sequence
  Synthetic
agctcagtgataccccaaattagatgaaagtgtgcccttctggtggagaa

SEQ ID NO: 2062 - DNA, 100 bp, Artificial Sequence
  Synthetic
ggcccttccttcctcattgttgtttggtatgcgcacagttcctgtgggactgggccgtgagttttccattggaaagaagttcagtggtcccattgttaac

SEQ ID NO: 2063 - DNA, 50 bp, Artificial Sequence
  Synthetic
gtcccacaggaactgtgcgcataccaaacaacaatgaggaaggaagggcc

SEQ ID NO: 2064 - DNA, 50 bp, Artificial Sequence
  Synthetic
gttaacaatgggaccactgaacttctttccaatggaaaactcacggccca

SEQ ID NO: 2065 - DNA, 100 bp, Artificial Sequence
  Synthetic
taggggccacttttcctttgaggctctagtggaggtggatgtccttctctgccaggcttggcacatgatgtgaagaataaatgcccaattcttactgttc

SEQ ID NO: 2066 - DNA, 50 bp, Artificial Sequence
  Synthetic
agagaaggacatccacctccactagagcctcaaaggaaaagtggccccta

SEQ ID NO: 2067 - DNA, 50 bp, Artificial Sequence
  Synthetic
gaacagtaagaattgggcatttattcttcacatcatgtgccaagcctggc

SEQ ID NO: 2068 - DNA, 100 bp, Artificial Sequence
  Synthetic
gtcacaggtcatttgtggggcaaacatcactgcttttccatcaagggagcaaagaataagtgggagttttggaagagtttggatgagagacgccaaggtg

SEQ ID NO: 2069 - DNA, 50 bp, Artificial Sequence
  Synthetic
gctcccttgatggaaaagcagtgatgtttgccccacaaatgacctgtgac

SEQ ID NO: 2070 - DNA, 50 bp, Artificial Sequence
  Synthetic
caccttggcgtctctcatccaaactcttccaaaactcccacttattcttt

SEQ ID NO: 2071 - DNA, 100 bp, Artificial Sequence
  Synthetic
agatgctcaaggagaacaaggtgttgaagacactgaatgtggaatccaacttcatttctggagctgggattctgcgcctggtagaagccctcccatacaa

SEQ ID NO: 2072 - DNA, 50 bp, Artificial Sequence
  Synthetic
gttggattccacattcagtgtcttcaacaccttgttctccttgagcatct

SEQ ID NO: 2073 - DNA, 50 bp, Artificial Sequence
  Synthetic
ttgtatgggagggcttctaccaggcgcagaatcccagctccagaaatgaa

SEQ ID NO: 2074 - DNA, 100 bp, Artificial Sequence
  Synthetic
cccgagggcctagtgatcctggaagccagtgtgaaagacatagctgcattgaattccacgctgggttgttaccgctacagctacgtgggccagggccagg

SEQ ID NO: 2075 - DNA, 42 bp, Artificial Sequence
  Synthetic
aatgcagctatgtctttcacactggcttccaggatcactagg

SEQ ID NO: 2076 - DNA, 40 bp, Artificial Sequence
  Synthetic
gcccacgtagctgtagcggtaacaacccagcgtggaattc

SEQ ID NO: 2077 - DNA, 100 bp, Artificial Sequence
  Synthetic
agcaacaagaccaccacttcgaaacctgggattcaggaatgtgtggcctgcacagtgaagtgctggcaaccactaagaattcaaactggggcctccagaa

SEQ ID NO: 2078 - DNA, 50 bp, Artificial Sequence
  Synthetic
caggccacacattcctgaatcccaggtttcgaagtggtggtcttgttgct

SEQ ID NO: 2079 - DNA, 50 bp, Artificial Sequence
  Synthetic
ttctggaggccccagtttgaattcttagtggttgccagcacttcactgtg

SEQ ID NO: 2080 - DNA, 100 bp, Artificial Sequence
  Synthetic
gtcactgtacccggcctgctctaccgcttttaaggacgcttatgatcacattgcgcctacccagagaacccaggtcgtctttctattttcaggtcagctg

SEQ ID NO: 2081 - DNA, 50 bp, Artificial Sequence
  Synthetic
tgtgatcataagcgtccttaaaagcggtagagcaggccgggtacagtgac

SEQ ID NO: 2082 - DNA, 50 bp, Artificial Sequence
  Synthetic
cagctgacctgaaaatagaaagacgacctgggttctctgggtaggcgcaa

SEQ ID NO: 2083 - DNA, 100 bp, Artificial Sequence
  Synthetic
caaagccctcatcgacagaaacatccaggccaccctggaaagccagaagaaactcaactggtgtcgagaagtccggaagcttgtggcgctgaaaacgaac

SEQ ID NO: 2084 - DNA, 43 bp, Artificial Sequence
  Synthetic
tcttctggctttccagggtggcctggatgtttctgtcgatgag

SEQ ID NO: 2085 - DNA, 50 bp, Artificial Sequence
  Synthetic
gttcgttttcagcgccacaagcttccggacttctcgacaccagttgagtt

SEQ ID NO: 2086 - DNA, 100 bp, Artificial Sequence
  Synthetic
tgcaaaaccatttgcaaccatcagagccagcgcacctgtgcagccttctgcaggtcactcagctgccgcaaggagcaaggcaagttctatgaccatctcc

SEQ ID NO: 2087 - DNA, 50 bp, Artificial Sequence
  Synthetic
cagaaggctgcacaggtgcgctggctctgatggttgcaaatggttttgca

SEQ ID NO: 2088 - DNA, 42 bp, Artificial Sequence
  Synthetic
tcatagaacttgccttgctccttgcggcagctgagtgacctg

SEQ ID NO: 2089 - DNA, 100 bp, Artificial Sequence
  Synthetic
ctcagggagcctcgtcatcgtcattgtttgctccacagttggcctaatcatatgtgtgaaaagaagaaagccaaggggtgatgtagtcaaggtgatcgtc

SEQ ID NO: 2090 - DNA, 50 bp, Artificial Sequence
  Synthetic
tgattaggccaactgtggagcaaacaatgacgatgacgaggctccctgag

SEQ ID NO: 2091 - DNA, 50 bp, Artificial Sequence
  Synthetic
gacgatcaccttgactacatcaccccttggctttcttcttttcacacata

SEQ ID NO: 2092 - DNA, 100 bp, Artificial Sequence
  Synthetic
tctgaccattgctttccactcccagctatggaggaaggcgcaaccattcttgtcaccacgaaaacgaatgactattgcaagagcctgccagctgctttga

SEQ ID NO: 2093 - DNA, 46 bp, Artificial Sequence
  Synthetic
agaatggttgcgccttcctccatagctgggagtggaaagcaatggt

SEQ ID NO: 2094 - DNA, 50 bp, Artificial Sequence
  Synthetic
tcaaagcagctggcaggctcttgcaatagtcattcgttttcgtggtgaca

SEQ ID NO: 2095 - DNA, 100 bp, Artificial Sequence
  Synthetic
tgaatcaggagactgtagacagcaagaattcagggatcggtctggaaactgtgttccctgcaaccagtgtgggccaggcatggagttgtctaaggaatgt

SEQ ID NO: 2096 - DNA, 50 bp, Artificial Sequence
  Synthetic
agtttccagaccgatccctgaattcttgctgtctacagtctcctgattca

SEQ ID NO: 2097 - DNA, 43 bp, Artificial Sequence
  Synthetic
ttagacaactccatgcctggcccacactggttgcagggaacac

SEQ ID NO: 2098 - DNA, 100 bp, Artificial Sequence
  Synthetic
ggggggacccagcctgggacagacctgcgtgctgatcgtgatcttcacagtgctcctgcagtctctctgtgtggctgtaacttacgtgtactttaccaac

SEQ ID NO: 2099 - DNA, 35 bp, Artificial Sequence
  Synthetic
ctgtgaagatcacgatcagcacgcaggtctgtccc

SEQ ID NO: 2100 - DNA, 50 bp, Artificial Sequence
  Synthetic
gttggtaaagtacacgtaagttacagccacacagagagactgcaggagca

SEQ ID NO: 2101 - DNA, 100 bp, Artificial Sequence
  Synthetic
gaaggtcaggtctgtcaactccttgatggtggcctctctgacttacaaagacaaagtctacttgaatgtgaccactgacaatacctccctggatgacttc

SEQ ID NO: 2102 - DNA, 50 bp, Artificial Sequence
  Synthetic
ctttgtaagtcagagaggccaccatcaaggagttgacagacctgaccttc

SEQ ID NO: 2103 - DNA, 50 bp, Artificial Sequence
  Synthetic
gaagtcatccagggaggtattgtcagtggtcacattcaagtagactttgt

SEQ ID NO: 2104 - DNA, 100 bp, Artificial Sequence
  Synthetic
caggtggtacctgtggaagggcccgagcgttcatttgttgtctcctcactggaccctgaccacaagtacagattcactctgtttggaattgcgaacaaga

SEQ ID NO: 2105 - DNA, 50 bp, Artificial Sequence
  Synthetic
agtgaggagacaacaaatgaacgctcgggcccttccacaggtaccacctg

SEQ ID NO: 2106 - DNA, 50 bp, Artificial Sequence
  Synthetic
tcttgttcgcaattccaaacagagtgaatctgtacttgtggtcagggtcc

SEQ ID NO: 2107 - DNA, 100 bp, Artificial Sequence
  Synthetic
tttcagctcttgacctgtcccctctggctgcctctgagtctgaatctcccaaagagagaaaccaatttctaagaggactggattgcagaagactcgggga

SEQ ID NO: 2108 - DNA, 35 bp, Artificial Sequence
  Synthetic
gggagattcagactcagaggcagccagaggggaca

SEQ ID NO: 2109 - DNA, 50 bp, Artificial Sequence
  Synthetic
tccccgagtcttctgcaatccagtcctcttagaaattggtttctctcttt

SEQ ID NO: 2110 - DNA, 100 bp, Artificial Sequence
  Synthetic
aatgagcagctttgactttgacaggcggtttgtgcaggaaagcacagtgccgtgttgtttacagcttttctagagcagctgtgcgaccagggtagagagt

SEQ ID NO: 2111 - DNA, 45 bp, Artificial Sequence
  Synthetic
gcactgtgctttcctgcacaaaccgcctgtcaaagtcaaagctgc

SEQ ID NO: 2112 - DNA, 50 bp, Artificial Sequence
  Synthetic
actctctaccctggtcgcacagctgctctagaaaagctgtaaacaacacg

SEQ ID NO: 2113 - DNA, 100 bp, Artificial Sequence
  Synthetic
ggggagcagggctcactccagccacctgaagtccaaaaagggtcagtctacctcccgccataaaaaactcatgttcaagacagaagggcctgactcagac

SEQ ID NO: 2114 - DNA, 44 bp, Artificial Sequence
  Synthetic
tagactgaccctttttggacttcaggtggctggagtgagccctg

SEQ ID NO: 2115 - DNA, 50 bp, Artificial Sequence
  Synthetic
gtctgagtcaggcccttctgtcttgaacatgagttttttatggcgggagg

SEQ ID NO: 2116 - DNA, 100 bp, Artificial Sequence
  Synthetic
caagccgggggaataatgaggtggtgggcggaacggattccagcatggacgtcttccacctggagggcatgactacatctgtcatggcccagttcaatct

SEQ ID NO: 2117 - DNA, 39 bp, Artificial Sequence
  Synthetic
gtccatgctggaatccgttccgcccaccacctcattatt

SEQ ID NO: 2118 - DNA, 36 bp, Artificial Sequence
  Synthetic
catgacagatgtagtcatgccctccaggtggaagac

SEQ ID NO: 2119 - DNA, 100 bp, Artificial Sequence
  Synthetic
cctctctgagctctgcatttgtctattctccagctgaccctggttctctctcttagcatcctgccttagagccaggcacacactgtgctttctattgtac

SEQ ID NO: 2120 - DNA, 50 bp, Artificial Sequence
  Synthetic
gagagaaccagggtcagctggagaatagacaaatgcagagctcagagagg

SEQ ID NO: 2121 - DNA, 50 bp, Artificial Sequence
  Synthetic
gtacaatagaaagcacagtgtgtgcctggctctaaggcaggatgctaaga

SEQ ID NO: 2122 - DNA, 100 bp, Artificial Sequence
  Synthetic
tgggacctgctcttaacctcaaacctaggaccgtcttgctttgtcattgggcatggagagaacccatttctccagacttttacctacccgtgcctgagaa

SEQ ID NO: 2123 - DNA, 50 bp, Artificial Sequence
  Synthetic
ccaatgacaaagcaagacggtcctaggtttgaggttaagagcaggtccca

SEQ ID NO: 2124 - DNA, 50 bp, Artificial Sequence
  Synthetic
ttctcaggcacgggtaggtaaaagtctggagaaatgggttctctccatgc

SEQ ID NO: 2125 - DNA, 100 bp, Artificial Sequence
  Synthetic
cgagtgatgggtctaggccctgaaactgatgtcctagcaataacctcttgatccctactcaccgagtgttgagcccaaggggggatttgtagaacaagcc

SEQ ID NO: 2126 - DNA, 50 bp, Artificial Sequence
  Synthetic
caagaggttattgctaggacatcagtttcagggcctagacccatcactcg

SEQ ID NO: 2127 - DNA, 47 bp, Artificial Sequence
  Synthetic
ttgttctacaaatccccccttgggctcaacactcggtgagtagggat

SEQ ID NO: 2128 - DNA, 100 bp, Artificial Sequence
  Synthetic
atatgatgccctgcttccttggccgtttaagcagaaagtgacactcatgctgatggatcaggggtcctctcgacgtcatttgggagatgcattcaagccc

SEQ ID NO: 2129 - DNA, 50 bp, Artificial Sequence
  Synthetic
gcatgagtgtcactttctgcttaaacggccaaggaagcagggcatcatat

SEQ ID NO: 2130 - DNA, 48 bp, Artificial Sequence
  Synthetic
gcttgaatgcatctcccaaatgacgtcgagaggacccctgatccatca

SEQ ID NO: 2131 - DNA, 100 bp, Artificial Sequence
  Synthetic
gtggaggccgaggacattttcctgaagggcaggggttggcaacttttcaacatggagtgccaaactgctaacccgtcttctagtgtgtgagaatagggac

SEQ ID NO: 2132 - DNA, 46 bp, Artificial Sequence
  Synthetic
ttgaaaagttgccaacccctgcccttcaggaaaatgtcctcggcct

SEQ ID NO: 2133 - DNA, 47 bp, Artificial Sequence
  Synthetic
cctattctcacacactagaagacgggttagcagtttggcactccatg

SEQ ID NO: 2134 - DNA, 100 bp, Artificial Sequence
  Synthetic
aaggatgctgcgagtgtgtagagagctgacagatgtccaaagctactgggccatccaggggtctttaaccagaagagagaggagagcctcaggagttagg

SEQ ID NO: 2135 - DNA, 37 bp, Artificial Sequence
  Synthetic
cccagtagctttggacatctgtcagctctctacacac

SEQ ID NO: 2136 - DNA, 36 bp, Artificial Sequence
  Synthetic
ctctcctctctcttctggttaaagacccctggatgg

SEQ ID NO: 2137 - DNA, 100 bp, Artificial Sequence
  Synthetic
gatttactacctggcccctggtggcttgcaaaattgttggaagagctggagaagcagactctgctgaatttccaggaactcccagcgccagattcatcat

SEQ ID NO: 2138 - DNA, 50 bp, Artificial Sequence
  Synthetic
tccagctcttccaacaattttgcaagccaccaggggccaggtagtaaatc

SEQ ID NO: 2139 - DNA, 50 bp, Artificial Sequence
  Synthetic
atgatgaatctggcgctgggagttcctggaaattcagcagagtctgcttc

SEQ ID NO: 2140 - DNA, 100 bp, Artificial Sequence
  Synthetic
aagagacagaaaacataattgcagcaaatcactgggttctacctgcagctgaattccatgggctttgggacagcttggtatacgatgtggaagtcaaatc

SEQ ID NO: 2141 - DNA, 45 bp, Artificial Sequence
  Synthetic
agctgcaggtagaacccagtgatttgctgcaattatgttttctgt

SEQ ID NO: 2142 - DNA, 50 bp, Artificial Sequence
  Synthetic
gatttgacttccacatcgtataccaagctgtcccaaagcccatggaattc

SEQ ID NO: 2143 - DNA, 100 bp, Artificial Sequence
  Synthetic
agcatcgtataggctaggggattgaactgtggactgattcagtgtaaataaaaacaaattaacaggtagtagttcctgtcagttctgttggaagcagccc

SEQ ID NO: 2144 - DNA, 50 bp, Artificial Sequence
  Synthetic
tatttacactgaatcagtccacagttcaatcccctagcctatacgatgct

SEQ ID NO: 2145 - DNA, 50 bp, Artificial Sequence
  Synthetic
gggctgcttccaacagaactgacaggaactactacctgttaatttgtttt

SEQ ID NO: 2146 - DNA, 100 bp, Artificial Sequence
  Synthetic
tggcggagcgtcggttgtagcactctgcgcgcccgctcttctgctgctgtttgtctacttcctcctgcttccccgccgccgccgccgccatcatgaggga

SEQ ID NO: 2147 - DNA, 36 bp, Artificial Sequence
  Synthetic
acagcagcagaagagcgggcgcgcagagtgctacaa

SEQ ID NO: 2148 - DNA, 35 bp, Artificial Sequence
  Synthetic
gcggcggcggcggggaagcaggaggaagtagacaa

SEQ ID NO: 2149 - DNA, 100 bp, Artificial Sequence
  Synthetic
cccctcagagcacagatcagggacctcacgcatctctttctcatatacatggactctctgttggcctgcaaacacatttacttctcctcttatgagacta

SEQ ID NO: 2150 - DNA, 50 bp, Artificial Sequence
  Synthetic
atgtatatgagaaagagatgcgtgaggtccctgatctgtgctctgagggg

SEQ ID NO: 2151 - DNA, 50 bp, Artificial Sequence
  Synthetic
tagtctcataagaggagaagtaaatgtgtttgcaggccaacagagagtcc

SEQ ID NO: 2152 - DNA, 100 bp, Artificial Sequence
  Synthetic
cagccaagatggtgaagcagatcgagagcaagactgcttttcaggaagccttggacgctgcaggtgataaacttgtagtagttgacttctcagccacgtg

SEQ ID NO: 2153 - DNA, 47 bp, Artificial Sequence
  Synthetic
ggcttcctgaaaagcagtcttgctctcgatctgcttcaccatcttgg

SEQ ID NO: 2154 - DNA, 50 bp, Artificial Sequence
  Synthetic
cacgtggctgagaagtcaactactacaagtttatcacctgcagcgtccaa

SEQ ID NO: 2155 - DNA, 100 bp, Artificial Sequence
  Synthetic
agcagattgaaatgcaaaaacccacacctctggaagataccttcacggccgctgctggagcttctgttgctgtgaatacttctctcagtgtgagaggtta

SEQ ID NO: 2156 - DNA, 50 bp, Artificial Sequence
  Synthetic
ggccgtgaaggtatcttccagaggtgtgggtttttgcatttcaatctgct

SEQ ID NO: 2157 - DNA, 50 bp, Artificial Sequence
  Synthetic
taacctctcacactgagagaagtattcacagcaacagaagctccagcagc

SEQ ID NO: 2158 - DNA, 100 bp, Artificial Sequence
  Synthetic
tcatcgctgacagctgaggaagtctgcatccacattgcacataaagttggtatcactcctccttgcttcaatctctttgccctcttcgatgctcaggccc

SEQ ID NO: 2159 - DNA, 50 bp, Artificial Sequence
  Synthetic
ccaactttatgtgcaatgtggatgcagacttcctcagctgtcagcgatga

SEQ ID NO: 2160 - DNA, 50 bp, Artificial Sequence
  Synthetic
gggcctgagcatcgaagagggcaaagagattgaagcaaggaggagtgata

SEQ ID NO: 2161 - DNA, 100 bp, Artificial Sequence
  Synthetic
tcagattattcaggacagggagttgaccaactgcaaagagtgattgacaccatcaaaaccaaccctgacgacagaagaatcatcatgtgcgcttggaatc

SEQ ID NO: 2162 - DNA, 50 bp, Artificial Sequence
  Synthetic
gtgtcaatcactctttgcagttggtcaactccctgtcctgaataatctga

SEQ ID NO: 2163 - DNA, 50 bp, Artificial Sequence
  Synthetic
gattccaagcgcacatgatgattcttctgtcgtcagggttggttttgatg

SEQ ID NO: 2164 - DNA, 100 bp, Artificial Sequence
  Synthetic
cggccgcccgagggactttgaacatgtcggggatcgccctcagcagactcgcccaggagaggaaagcatggaggaaagaccacccatttggtttcgtggc

SEQ ID NO: 2165 - DNA, 37 bp, Artificial Sequence
  Synthetic
gagtctgctgagggcgatccccgacatgttcaaagtc

SEQ ID NO: 2166 - DNA, 48 bp, Artificial Sequence
  Synthetic
cacgaaaccaaatgggtggtctttcctccatgctttcctctcctgggc

SEQ ID NO: 2167 - DNA, 100 bp, Artificial Sequence
  Synthetic
cctctccgccacttccctcgcttctgaccatagtttgcggggaagggagcgagcgcgtcgaaaaccaaggaacgtgcgcgctgacgtcacggttgaggct

SEQ ID NO: 2168 - DNA, 42 bp, Artificial Sequence
  Synthetic
gctcccttccccgcaaactatggtcagaagcgagggaagtgg

SEQ ID NO: 2169 - DNA, 38 bp, Artificial Sequence
  Synthetic
gacgtcagcgcgcacgttccttggttttcgacgcgctc

SEQ ID NO: 2170 - DNA, 100 bp, Artificial Sequence
  Synthetic
catcgcgacggccaaaaggagcggcgcggtcttcgtggtgttcgtggcaggtgatgatgaacagtctacacagatggctgcaagttgggaagatgataaa

SEQ ID NO: 2171 - DNA, 42 bp, Artificial Sequence
  Synthetic
ctgccacgaacaccacgaagaccgcgccgctccttttggccg

SEQ ID NO: 2172 - DNA, 50 bp, Artificial Sequence
  Synthetic
tttatcatcttcccaacttgcagccatctgtgtagactgttcatcatcac

SEQ ID NO: 2173 - DNA, 100 bp, Artificial Sequence
  Synthetic
gttcttgcgtataagagtcaacctaggaaaaaggagagccttcttacatgcttagcagatctcttccatagcatagccactcagaagaaaaaggttggag

SEQ ID NO: 2174 - DNA, 50 bp, Artificial Sequence
  Synthetic
catgtaagaaggctctcctttttcctaggttgactcttatacgcaagaac

SEQ ID NO: 2175 - DNA, 50 bp, Artificial Sequence
  Synthetic
ctccaacctttttcttctgagtggctatgctatggaagagatctgctaag

SEQ ID NO: 2176 - DNA, 100 bp, Artificial Sequence
  Synthetic
ggaaatgcccaaaaccttcagagattgacacgctgtcattttccatttccgttcctggatctacggagtcttctaagagattttgcaatgaggagaagca

SEQ ID NO: 2177 - DNA, 50 bp, Artificial Sequence
  Synthetic
ggaaatggaaaatgacagcgtgtcaatctctgaaggttttgggcatttcc

SEQ ID NO: 2178 - DNA, 50 bp, Artificial Sequence
  Synthetic
tgcttctcctcattgcaaaatctcttagaagactccgtagatccaggaac

SEQ ID NO: 2179 - DNA, 100 bp, Artificial Sequence
  Synthetic
aataccagagttagctgggtatagaggtggctcaaaggaagtgtccgtgggcagggggaggaatgaacaaaatggcgctgtttctttggctcagactcct

SEQ ID NO: 2180 - DNA, 50 bp, Artificial Sequence
  Synthetic
ccacggacacttcctttgagccacctctatacccagctaactctggtatt

SEQ ID NO: 2181 - DNA, 50 bp, Artificial Sequence
  Synthetic
aggagtctgagccaaagaaacagcgccattttgttcattcctccccctgc

SEQ ID NO: 2182 - DNA, 100 bp, Artificial Sequence
  Synthetic
ccacctcagtgacacggccattgggatgatgaccaggattgcagttctcaagtggctctaccacctctacatcaaaactcctcggaagatgttccggcac

SEQ ID NO: 2183 - DNA, 45 bp, Artificial Sequence
  Synthetic
tgagaactgcaatcctggtcatcatcccaatggccgtgtcactga

SEQ ID NO: 2184 - DNA, 46 bp, Artificial Sequence
  Synthetic
cggaacatcttccgaggagttttgatgtagaggtggtagagccact

SEQ ID NO: 2185 - DNA, 100 bp, Artificial Sequence
  Synthetic
tcaaatccgaatttagccaagccataccggccagcaagagggtttctgtggtgcttctctctgcactttacccagcatcttcaggaggaactgcaactat

SEQ ID NO: 2186 - DNA, 50 bp, Artificial Sequence
  Synthetic
cacagaaaccctcttgctggccggtatggcttggctaaattcggatttga

SEQ ID NO: 2187 - DNA, 50 bp, Artificial Sequence
  Synthetic
atagttgcagttcctcctgaagatgctgggtaaagtgcagagagaagcac

SEQ ID NO: 2188 - DNA, 100 bp, Artificial Sequence
  Synthetic
gcgctttctcagtcacaagccatgatgaattggtgactcagacgctttgtgctttttcctttgcttcttgagaccggggtgtgtgtggctcagcttccac

SEQ ID NO: 2189 - DNA, 50 bp, Artificial Sequence
  Synthetic
acaaagcgtctgagtcaccaattcatcatggcttgtgactgagaaagcgc

SEQ ID NO: 2190 - DNA, 50 bp, Artificial Sequence
  Synthetic
gtggaagctgagccacacacaccccggtctcaagaagcaaaggaaaaagc

SEQ ID NO: 2191 - DNA, 100 bp, Artificial Sequence
  Synthetic
gatgatgaagagtatcaggaatttgaagagatgctggaacatgcagagtctgcacaagactttgcctcccgggccaaactggcagttcaaaaactagtac

SEQ ID NO: 2192 - DNA, 50 bp, Artificial Sequence
  Synthetic
gactctgcatgttccagcatctcttcaaattcctgatactcttcatcatc

SEQ ID NO: 2193 - DNA, 50 bp, Artificial Sequence
  Synthetic
gtactagtttttgaactgccagtttggcccgggaggcaaagtcttgtgca

SEQ ID NO: 2194 - DNA, 100 bp, Artificial Sequence
  Synthetic
acagacaagagtgggcgacagtggaagctgaagtccttccagaccagggacaaccagggcattctctatgaagctgcacccacctccaccctcacctgtg

SEQ ID NO: 2195 - DNA, 35 bp, Artificial Sequence
  Synthetic
tccctggtctggaaggacttcagcttccactgtcg

SEQ ID NO: 2196 - DNA, 38 bp, Artificial Sequence
  Synthetic
tggaggtgggtgcagcttcatagagaatgccctggttg

SEQ ID NO: 2197 - DNA, 100 bp, Artificial Sequence
  Synthetic
cacctgcaacccctgccccctgggttacaaggaagaaaataacacaggtgaatgttgtgggagatgtttgcctacggcttgcaccattcagctaagagga

SEQ ID NO: 2198 - DNA, 50 bp, Artificial Sequence
  Synthetic
cacctgtgttattttcttccttgtaacccagggggcaggggttgcaggtg

SEQ ID NO: 2199 - DNA, 50 bp, Artificial Sequence
  Synthetic
tcctcttagctgaatggtgcaagccgtaggcaaacatctcccacaacatt

SEQ ID NO: 2200 - DNA, 100 bp, Artificial Sequence
  Synthetic
cctctggactgaaccccacatctgcacctccaacatctgcttcagcggtccctgtttctcctgttccacagtcgccaatacctcccttacttcaggaccc

SEQ ID NO: 2201 - DNA, 39 bp, Artificial Sequence
  Synthetic
gaccgctgaagcagatgttggaggtgcagatgtggggtt

SEQ ID NO: 2202 - DNA, 50 bp, Artificial Sequence
  Synthetic
gggtcctgaagtaagggaggtattggcgactgtggaacaggagaaacagg

SEQ ID NO: 2203 - DNA, 100 bp, Artificial Sequence
  Synthetic
tggcccagcctctcattttgaaacaagacctcagacatacgtggatcatatggatggatcttactcactttctgccttgccatttagtcagatgagtgag

SEQ ID NO: 2204 - DNA, 50 bp, Artificial Sequence
  Synthetic
tatgatccacgtatgtctgaggtcttgtttcaaaatgagaggctgggcca

SEQ ID NO: 2205 - DNA, 50 bp, Artificial Sequence
  Synthetic
ctcactcatctgactaaatggcaaggcagaaagtgagtaagatccatcca

SEQ ID NO: 2206 - DNA, 100 bp, Artificial Sequence
  Synthetic
gcatcctcagtggtggctttgacttcgcgctgcacctaacagaccttgaaacaggaacccagctatttagtggtcgaagtgactttagaatcactacctt

SEQ ID NO: 2207 - DNA, 45 bp, Artificial Sequence
  Synthetic
ttcaaggtctgttaggtgcagcgcgaagtcaaagccaccactgag

SEQ ID NO: 2208 - DNA, 50 bp, Artificial Sequence
  Synthetic
aaggtagtgattctaaagtcacttcgaccactaaatagctgggttcctgt

SEQ ID NO: 2209 - DNA, 100 bp, Artificial Sequence
  Synthetic
ctacctcttcaattggaatggctttggggccacaagtgaccgctttgccctgagagctgaatctatcgactgcatggttccagtcaccgagagtctgctg

SEQ ID NO: 2210 - DNA, 46 bp, Artificial Sequence
  Synthetic
gggcaaagcggtcacttgtggccccaaagccattccaattgaagag

SEQ ID NO: 2211 - DNA, 45 bp, Artificial Sequence
  Synthetic
gactctcggtgactggaaccatgcagtcgatagattcagctctca

SEQ ID NO: 2212 - DNA, 100 bp, Artificial Sequence
  Synthetic
cagagtattgggaaaagacttgccttctgccagaacttaacccaaatacacacagagagcaccatgaagccctggattcttctactcgtcatgttcatct

SEQ ID NO: 2213 - DNA, 50 bp, Artificial Sequence
  Synthetic
tgtatttgggttaagttctggcagaaggcaagtcttttcccaatactctg

SEQ ID NO: 2214 - DNA, 50 bp, Artificial Sequence
  Synthetic
agatgaacatgacgagtagaagaatccagggcttcatggtgctctctgtg

SEQ ID NO: 2215 - DNA, 100 bp, Artificial Sequence
  Synthetic
aaaagagtgcacgccagtatcacgtacagttctttggtgacgccccagaaagagcttggatatttgagaagagcctcgtagcttttgaaggagaaggaca

SEQ ID NO: 2216 - DNA, 50 bp, Artificial Sequence
  Synthetic
ttctggggcgtcaccaaagaactgtacgtgatactggcgtgcactctttt

SEQ ID NO: 2217 - DNA, 50 bp, Artificial Sequence
  Synthetic
tgtccttctccttcaaaagctacgaggctcttctcaaatatccaagctct

SEQ ID NO: 2218 - DNA, 100 bp, Artificial Sequence
  Synthetic
ccaactcgcctgtggacggggaggctctccctctctctcatcttacatttctcaccctactctggatggtgtgtggtttttaaagaagggggctttcttt

SEQ ID NO: 2219 - DNA, 48 bp, Artificial Sequence
  Synthetic
atgtaagatgagagagagggagagcctccccgtccacaggcgagttgg

SEQ ID NO: 2220 - DNA, 52 bp, Artificial Sequence
  Synthetic
aaagaaagcccccttctttaaaaaccacacaccatccagagtagggtgagaa

SEQ ID NO: 2221 - DNA, 100 bp, Artificial Sequence
  Synthetic
tggtttgcccaaggactacaaataaaccaacgggaaaaaagaaaggttccagttttgtctgaaaattctgattaagcctctgggccctacagcctggaga

SEQ ID NO: 2222 - DNA, 48 bp, Artificial Sequence
  Synthetic
ggaacctttcttttttcccgttggtttatttgtagtccttgggcaaac

SEQ ID NO: 2223 - DNA, 50 bp, Artificial Sequence
  Synthetic
tctccaggctgtagggcccagaggcttaatcagaattttcagacaaaact

SEQ ID NO: 2224 - DNA, 100 bp, Artificial Sequence
  Synthetic
ggagttaagacagcgcttggggatggatgccctggttgctgaagaggaggcggaagccaaggggaatgaagtgaggccagtggccgggtctgctgagtcc

SEQ ID NO: 2225 - DNA, 35 bp, Artificial Sequence
  Synthetic
cctcctcttcagcaaccagggcatccatccccaag

SEQ ID NO: 2226 - DNA, 36 bp, Artificial Sequence
  Synthetic
cggccactggcctcacttcattccccttggcttccg

SEQ ID NO: 2227 - DNA, 100 bp, Artificial Sequence
  Synthetic
atagaggggcctgtgcaatctcctaaggcctgtgtttctgccatatattttattataaattacaatccactcatccacctgccctccaccaggagtgggc

SEQ ID NO: 2228 - DNA, 50 bp, Artificial Sequence
  Synthetic
aaatatatggcagaaacacaggccttaggagattgcacaggcccctctat

SEQ ID NO: 2229 - DNA, 49 bp, Artificial Sequence
  Synthetic
cccactcctggtggagggcaggtggatgagtggattgtaatttataata

SEQ ID NO: 2230 - DNA, 100 bp, Artificial Sequence
  Synthetic
ggagctcaaggacaagaagctcttcctgaagcgcgataacctcctcatagctgacattgaacttggctgcggcaactttggctcagtgcgccagggcgtg

SEQ ID NO: 2231 - DNA, 50 bp, Artificial Sequence
  Synthetic
ctatgaggaggttatcgcgcttcaggaagagcttcttgtccttgagctcc

SEQ ID NO: 2232 - DNA, 44 bp, Artificial Sequence
  Synthetic
ctggcgcactgagccaaagttgccgcagccaagttcaatgtcag

SEQ ID NO: 2233 - DNA, 100 bp, Artificial Sequence
  Synthetic
aggccgtctcggccctcgacctctccctgttgtccttcttcctccaccacctgacggggtgtcggtagcgtcttagccaagagtccaattaaagaacgaa

SEQ ID NO: 2234 - DNA, 46 bp, Artificial Sequence
  Synthetic
gtggtggaggaagaaggacaacagggagaggtcgagggccgagacg

SEQ ID NO: 2235 - DNA, 50 bp, Artificial Sequence
  Synthetic
ttcgttctttaattggactcttggctaagacgctaccgacaccccgtcag

SEQ ID NO: 2236 - DNA, 100 bp, Artificial Sequence
  Synthetic
gaacatacaattggagattcctgacttcagcaactctgtcctgagccatctaaaccagttgcgcatgcagggccgtctctgtgatattgtggtcaatgtg

SEQ ID NO: 2237 - DNA, 50 bp, Artificial Sequence
  Synthetic
gatggctcaggacagagttgctgaagtcaggaatctccaattgtatgttc

SEQ ID NO: 2238 - DNA, 50 bp, Artificial Sequence
  Synthetic
cacattgaccacaatatcacagagacggccctgcatgcgcaactggttta

SEQ ID NO: 2239 - DNA, 100 bp, Artificial Sequence
  Synthetic
caagacctgcggacggtgcttttcggtgcaaggaaacttacagaaacatgaacgcatccacctgggcttgaaggagttcgtctgtcagtattgcaacaag

SEQ ID NO: 2240 - DNA, 50 bp, Artificial Sequence
  Synthetic
catgtttctgtaagtttccttgcaccgaaaagcaccgtccgcaggtcttg

SEQ ID NO: 2241 - DNA, 50 bp, Artificial Sequence
  Synthetic
cttgttgcaatactgacagacgaactccttcaagcccaggtggatgcgtt

SEQ ID NO: 2242 - DNA, 100 bp, Artificial Sequence
  Synthetic
tggagataaggattccagatggcacttgagtgaagatgagaatagatcctatgtggagattgtagaagatgggtctggtgatctggtcatccaacaggtt

SEQ ID NO: 2243 - DNA, 50 bp, Artificial Sequence
  Synthetic
aggatctattctcatcttcactcaagtgccatctggaatccttatctcca

SEQ ID NO: 2244 - DNA, 50 bp, Artificial Sequence
  Synthetic
aacctgttggatgaccagatcaccagacccatcttctacaatctccacat

SEQ ID NO: 2245 - DNA, 100 bp, Artificial Sequence
  Synthetic
ggccaacagcttgcactggagaatcggaaaagcaccttgagttactggcttcccctttacctattccatcaaccttccttccacacagtagtactcccgc

SEQ ID NO: 2246 - DNA, 49 bp, Artificial Sequence
  Synthetic
agccagtaactcaaggtgcttttccgattctccagtgcaagctgttggc

SEQ ID NO: 2247 - DNA, 50 bp, Artificial Sequence
  Synthetic
gcgggagtactactgtgtggaaggaaggttgatggaataggtaaagggga

SEQ ID NO: 2248 - DNA, 100 bp, Artificial Sequence
  Synthetic
ctgctgaagctgttgtcagaatcttcctttggacaaaacatcactagctgactataaaaacaaaagtgtcatcattgaagccctgaagaggcagggaatt

SEQ ID NO: 2249 - DNA, 50 bp, Artificial Sequence
  Synthetic
cagctagtgatgttttgtccaaaggaagattctgacaacagcttcagcag

SEQ ID NO: 2250 - DNA, 50 bp, Artificial Sequence
  Synthetic
aattccctgcctcttcagggcttcaatgatgacacttttgtttttatagt

SEQ ID NO: 2251 - DNA, 100 bp, Artificial Sequence
  Synthetic
ccacgtgcccatctcaagacattccactcacagatttgaggttctggattccaggtctggagttttccaatgttaatgtaaacagaactggcacacacac

SEQ ID NO: 2252 - DNA, 50 bp, Artificial Sequence
  Synthetic
aatccagaacctcaaatctgtgagtggaatgtcttgagatgggcacgtgg

SEQ ID NO: 2253 - DNA, 50 bp, Artificial Sequence
  Synthetic
gtgtgtgtgccagttctgtttacattaacattggaaaactccagacctgg

SEQ ID NO: 2254 - DNA, 100 bp, Artificial Sequence
  Synthetic
aaagaatatgacagtctgagcgcaatcgcttgtcctcagagtggatgcactaggaagttgaggaatagagctgccctgagaaagcatctcctcattcatg

SEQ ID NO: 2255 - DNA, 50 bp, Artificial Sequence
  Synthetic
gtgcatccactctgaggacaagcgattgcgctcagactgtcatattcttt

SEQ ID NO: 2256 - DNA, 50 bp, Artificial Sequence
  Synthetic
catgaatgaggagatgctttctcagggcagctctattcctcaacttccta

SEQ ID NO: 2257 - DNA, 100 bp, Artificial Sequence
  Synthetic
gttgggatcgggagtttcggcacagactatcccatcaagccgttggctcctttcagctactacgttaccacgttcctaaaacgcaagctctccggaccag

SEQ ID NO: 2258 - DNA, 45 bp, Artificial Sequence
  Synthetic
ggagccaacggcttgatgggatagtctgtgccgaaactcccgatc

SEQ ID NO: 2259 - DNA, 50 bp, Artificial Sequence
  Synthetic
ctggtccggagagcttgcgttttaggaacgtggtaacgtagtagctgaaa

SEQ ID NO: 2260 - DNA, 100 bp, Artificial Sequence
  Synthetic
actagacccaaagtcaaactgtcagttctaaagcaaggcatctctgaagaaatatccaacagtgtcatcttggtagaaagattcctgtgggatggtctgt

SEQ ID NO: 2261 - DNA, 50 bp, Artificial Sequence
  Synthetic
tcttcagagatgccttgctttagaactgacagtttgactttgggtctagt

SEQ ID NO: 2262 - DNA, 50 bp, Artificial Sequence
  Synthetic
acagaccatcccacaggaatctttctaccaagatgacactgttggatatt

SEQ ID NO: 2263 - DNA, 100 bp, Artificial Sequence
  Synthetic
gggactggagcgctgaaaagttgttcctgaccaggctctaatgagaaattcctctctccccaggttatgaagacagtatggagtttccagaccatagtag

SEQ ID NO: 2264 - DNA, 50 bp, Artificial Sequence
  Synthetic
aatttctcattagagcctggtcaggaacaacttttcagcgctccagtccc

SEQ ID NO: 2265 - DNA, 50 bp, Artificial Sequence
  Synthetic
ctactatggtctggaaactccatactgtcttcataacctggggagagagg

SEQ ID NO: 2266 - DNA, 100 bp, Artificial Sequence
  Synthetic
agcgtttggttctcagtttaagtcgggcagcagggtgccaatgacctttatcactaactctaatggagaagtggaccatagagtaaggacttcagtgtca

SEQ ID NO: 2267 - DNA, 50 bp, Artificial Sequence
  Synthetic
taaaggtcattggcaccctgctgcccgacttaaactgagaaccaaacgct

SEQ ID NO: 2268 - DNA, 50 bp, Artificial Sequence
  Synthetic
tgacactgaagtccttactctatggtccacttctccattagagttagtga

SEQ ID NO: 2269 - DNA, 100 bp, Artificial Sequence
  Synthetic
tccgacccaacctgcctattccatccacagtactccgcaagtcatgttcagccacaatgagcaagccagctcctcttaacacctttctgtctattaagtc

SEQ ID NO: 2270 - DNA, 50 bp, Artificial Sequence
  Synthetic
tgaacatgacttgcggagtactgtggatggaataggcaggttgggtcgga

SEQ ID NO: 2271 - DNA, 50 bp, Artificial Sequence
  Synthetic
gacttaatagacagaaaggtgttaagaggagctggcttgctcattgtggc

SEQ ID NO: 2272 - DNA, 100 bp, Artificial Sequence
  Synthetic
ctgacaaatcagaagataaagggaagttaaaagccagcagttccagtcagccatcaagctctgaaagtggctcatttctcctcaaatctggcacaacacc

SEQ ID NO: 2273 - DNA, 50 bp, Artificial Sequence
  Synthetic
ctgactggaactgctggcttttaacttccctttatcttctgatttgtcag

SEQ ID NO: 2274 - DNA, 50 bp, Artificial Sequence
  Synthetic
ggtgttgtgccagatttgaggagaaatgagccactttcagagcttgatgg

SEQ ID NO: 2275 - DNA, 100 bp, Artificial Sequence
  Synthetic
tcagacagggcctgatctccgcagcccagtattacaagagttgccgggacctgctgggggagaatttccagaaggtctttaatgagctgctggtcctgct

SEQ ID NO: 2276 - DNA, 40 bp, Artificial Sequence
  Synthetic
gtcccggcaactcttgtaatactgggctgcggagatcagg

SEQ ID NO: 2277 - DNA, 44 bp, Artificial Sequence
  Synthetic
accagcagctcattaaagaccttctggaaattctcccccagcag

SEQ ID NO: 2278 - DNA, 100 bp, Artificial Sequence
  Synthetic
cagcacaatcatctcaactgaaagagtcccattctccctattaccacagctatgatccttattattctccaagttacatgcaccctgggcaggtcggtgc

SEQ ID NO: 2279 - DNA, 50 bp, Artificial Sequence
  Synthetic
gctgtggtaatagggagaatgggactctttcagttgagatgattgtgctg

SEQ ID NO: 2280 - DNA, 50 bp, Artificial Sequence
  Synthetic
gcaccgacctgcccagggtgcatgtaacttggagaataataaggatcata

SEQ ID NO: 2281 - DNA, 100 bp, Artificial Sequence
  Synthetic
atagctttgtcaccacaaagggcactgttctattcacagcacctcctgcttctgcctggcaactgtgtctccctgtgctatatttaattccaccagcaaa

SEQ ID NO: 2282 - DNA, 50 bp, Artificial Sequence
  Synthetic
agcaggaggtgctgtgaatagaacagtgccctttgtggtgacaaagctat

SEQ ID NO: 2283 - DNA, 50 bp, Artificial Sequence
  Synthetic
tttgctggtggaattaaatatagcacagggagacacagttgccaggcaga

SEQ ID NO: 2284 - DNA, 100 bp, Artificial Sequence
  Synthetic
tgcaagtagtacgtctggatagctgtcgaccaggctttggaaaaaatgaacgtctacacagtaattgcgctagctgttgtgtggtttgtagtcctgcgac

SEQ ID NO: 2285 - DNA, 50 bp, Artificial Sequence
  Synthetic
ttcattttttccaaagcctggtcgacagctatccagacgtactacttgca

SEQ ID NO: 2286 - DNA, 50 bp, Artificial Sequence
  Synthetic
gtcgcaggactacaaaccacacaacagctagcgcaattactgtgtagacg

SEQ ID NO: 2287 - DNA, 100 bp, Artificial Sequence
  Synthetic
ggagatgtaaatttgccatgacttcctggaggacagcagcatggagaaagatcctagaaaaggcctctgacttccctcacctcccaaccatcattacagg

SEQ ID NO: 2288 - DNA, 45 bp, Artificial Sequence
  Synthetic
ctttctccatgctgctgtcctccaggaagtcatggcaaatttaca

SEQ ID NO: 2289 - DNA, 46 bp, Artificial Sequence
  Synthetic
taatgatggttgggaggtgagggaagtcagaggccttttctaggat

SEQ ID NO: 2290 - DNA, 100 bp, Artificial Sequence
  Synthetic
tccccaggctctcggggtcgcgcgaggatgcttggcacgtaccccgtctacatacttcccgggcacccagcatggaaataaagcacccagcgctgccctg

SEQ ID NO: 2291 - DNA, 40 bp, Artificial Sequence
  Synthetic
tagacggggtacgtgccaagcatcctcgcgcgaccccgag

SEQ ID NO: 2292 - DNA, 40 bp, Artificial Sequence
  Synthetic
ctgggtgctttatttccatgctgggtgcccgggaagtatg

SEQ ID NO: 2293 - DNA, 100 bp, Artificial Sequence
  Synthetic
gatggcgtggaggtgcataatgccaagacaaagccgcgggaggagcagttcaacagcacgtaccgtgtggtcagcgtcctcaccgtcctgcaccaggact

SEQ ID NO: 2294 - DNA, 35 bp, Artificial Sequence
  Synthetic
aactgctcctcccgcggctttgtcttggcattatg

SEQ ID NO: 2295 - DNA, 42 bp, Artificial Sequence
  Synthetic
tgcaggacggtgaggacgctgaccacacggtacgtgctgttg

SEQ ID NO: 2296 - DNA, 100 bp, Artificial Sequence
  Synthetic
gccgctggccttcacacagaagaccatcgaccgcttggcgggtaaacccacccatgtcaatgtgtctgttgtcatggcggaggtggacggcacctgctac

SEQ ID NO: 2297 - DNA, 42 bp, Artificial Sequence
  Synthetic
tgggtttacccgccaagcggtcgatggtcttctgtgtgaagg

SEQ ID NO: 2298 - DNA, 45 bp, Artificial Sequence
  Synthetic
aggtgccgtccacctccgccatgacaacagacacattgacatggg

SEQ ID NO: 2299 - DNA, 100 bp, Artificial Sequence
  Synthetic
aagaccaagggctccggcttcttcgtcttcagccgcctggaggtgaccagggccgaatgggagcagaaagatgagttcatctgccgtgcagtccatgagg

SEQ ID NO: 2300 - DNA, 40 bp, Artificial Sequence
  Synthetic
ctggtcacctccaggcggctgaagacgaagaagccggagc

SEQ ID NO: 2301 - DNA, 38 bp, Artificial Sequence
  Synthetic
cacggcagatgaactcatctttctgctcccattcggcc

SEQ ID NO: 2302 - DNA, 100 bp, Artificial Sequence
  Synthetic
ttgctttccatcttgtgccaatacacatttggattcagcccaagccacacctaactcatgccagcagaggcaggaacacctgttgttgacacattctttg

SEQ ID NO: 2303 - DNA, 50 bp, Artificial Sequence
  Synthetic
gtgtggcttgggctgaatccaaatgtgtattggcacaagatggaaagcaa

SEQ ID NO: 2304 - DNA, 50 bp, Artificial Sequence
  Synthetic
caaagaatgtgtcaacaacaggtgttcctgcctctgctggcatgagttag

SEQ ID NO: 2305 - DNA, 100 bp, Artificial Sequence
  Synthetic
ctgtttggacttttatgcctgctcctcatctaagaagccaccatgcgaccgggtagaccactggctggattctacgctactctccgccgttccttcagaa

SEQ ID NO: 2306 - DNA, 50 bp, Artificial Sequence
  Synthetic
ggtcgcatggtggcttcttagatgaggagcaggcataaaagtccaaacag

SEQ ID NO: 2307 - DNA, 47 bp, Artificial Sequence
  Synthetic
tgaaggaacggcggagagtagcgtagaatccagccagtggtctaccc

SEQ ID NO: 2308 - DNA, 100 bp, Artificial Sequence
  Synthetic
aattcacacacggcaacccctaacgtttcaccaatacatgaaccggagtcccataatagcccagaggctcccattctcttccccgatgattggtatcctc

SEQ ID NO: 2309 - DNA, 50 bp, Artificial Sequence
  Synthetic
gactccggttcatgtattggtgaaacgttaggggttgccgtgtgtgaatt

SEQ ID NO: 2310 - DNA, 50 bp, Artificial Sequence
  Synthetic
gaggataccaatcatcggggaagagaatgggagcctctgggctattatgg

SEQ ID NO: 2311 - DNA, 100 bp, Artificial Sequence
  Synthetic
aattgttgacacggatagtcttggaaacccgtcactctcagtaattccctcgaatccctaccaggaacaactgtcagacactccattaattccactaaca

SEQ ID NO: 2312 - DNA, 50 bp, Artificial Sequence
  Synthetic
agggaattactgagagtgacgggtttccaagactatccgtgtcaacaatt

SEQ ID NO: 2313 - DNA, 50 bp, Artificial Sequence
  Synthetic
tgttagtggaattaatggagtgtctgacagttgttcctggtagggattcg

SEQ ID NO: 2314 - DNA, 100 bp, Artificial Sequence
  Synthetic
gaggttttgaaggatgcgattaaggaccttgttatgacaaagcccgctcctacctgcaatatcagggtgactgtgtgcagctttgacgatggagtagatt

SEQ ID NO: 2315 - DNA, 50 bp, Artificial Sequence
  Synthetic
ggagcgggctttgtcataacaaggtccttaatcgcatccttcaaaacctc

SEQ ID NO: 2316 - DNA, 50 bp, Artificial Sequence
  Synthetic
aatctactccatcgtcaaagctgcacacagtcaccctgatattgcaggta

SEQ ID NO: 2317 - DNA, 100 bp, Artificial Sequence
  Synthetic
gaggaagtatgaatccagtatgcctgcctgtaattgttgcgccctacctcttttggctggcggctattgccgcctcgtgtttcacggcctcagttagtac

SEQ ID NO: 2318 - DNA, 50 bp, Artificial Sequence
  Synthetic
gaggtagggcgcaacaattacaggcaggcatactggattcatacttcctc

SEQ ID NO: 2319 - DNA, 50 bp, Artificial Sequence
  Synthetic
gtactaactgaggccgtgaaacacgaggcggcaatagccgccagccaaaa

SEQ ID NO: 2320 - DNA, 100 bp, Artificial Sequence
  Synthetic
tgcccaagcctggatgttgactccattatccgccggacaccagatgttttacacgaggatctcttaaatttctaactcccgttattgaaaccacgcctgc

SEQ ID NO: 2321 - DNA, 50 bp, Artificial Sequence
  Synthetic
aaaacatctggtgtccggcggataatggagtcaacatccaggcttgggca

SEQ ID NO: 2322 - DNA, 50 bp, Artificial Sequence
  Synthetic
gcaggcgtggtttcaataacgggagttagaaatttaagagatcctcgtgt

SEQ ID NO: 2323 - DNA, 100 bp, Artificial Sequence
  Synthetic
ccaacatcagctggatgctttggggtatacactccatggtcttaaccatcccggggttcccgtgtctcctgccgttaaccaatatcatctcagccaggct

SEQ ID NO: 2324 - DNA, 50 bp, Artificial Sequence
  Synthetic
gatggttaagaccatggagtgtataccccaaagcatccagctgatgttgg

SEQ ID NO: 2325 - DNA, 50 bp, Artificial Sequence
  Synthetic
agcctggctgagatgatattggttaacggcaggagacacgggaaccccgg

SEQ ID NO: 2326 - DNA, 100 bp, Artificial Sequence
  Synthetic
acaatcggaaactttaagccatattacccgtggaatgcaccacctaatgaaaatccatatcacgcgcggagaggcataaaagaacacgtaatccagaacg

SEQ ID NO: 2327 - DNA, 50 bp, Artificial Sequence
  Synthetic
tcattaggtggtgcattccacgggtaatatggcttaaagtttccgattgt

SEQ ID NO: 2328 - DNA, 50 bp, Artificial Sequence
  Synthetic
cgttctggattacgtgttcttttatgcctctccgcgcgtgatatggattt

SEQ ID NO: 2329 - DNA, 100 bp, Artificial Sequence
  Synthetic
ctcccgtcgttatcttggagaatgtcggccaggggcaacagcagactctggagtgcggaggaactgctaaacaggaaagggacatgttggggctggggga

SEQ ID NO: 2330 - DNA, 50 bp, Artificial Sequence
  Synthetic
cagagtctgctgttgcccctggccgacattctccaagataacgacgggag

SEQ ID NO: 2331 - DNA, 39 bp, Artificial Sequence
  Synthetic
caacatgtccctttcctgtttagcagttcctccgcactc

SEQ ID NO: 2332 - DNA, 100 bp, Artificial Sequence
  Synthetic
cggtgtttgtggcagttcatgtcccggatgtgttactaaatgggtggcgctggaggcttggggcgataccaccactcgtttgtctgttggcgattggtgt

SEQ ID NO: 2333 - DNA, 50 bp, Artificial Sequence
  Synthetic
gcgccacccatttagtaacacatccgggacatgaactgccacaaacaccg

SEQ ID NO: 2334 - DNA, 50 bp, Artificial Sequence
  Synthetic
acaccaatcgccaacagacaaacgagtggtggtatcgccccaagcctcca

SEQ ID NO: 2335 - DNA, 100 bp, Artificial Sequence
  Synthetic
agcaagtcgatttgaatgacataggcgacaaagtgaggtggcatttgtcagaagtttcaaagtcgtgtaagaacattggactaaagtggtgtgcggcagc

SEQ ID NO: 2336 - DNA, 50 bp, Artificial Sequence
  Synthetic
tgacaaatgccacctcactttgtcgcctatgtcattcaaatcgacttgct

SEQ ID NO: 2337 - DNA, 50 bp, Artificial Sequence
  Synthetic
gctgccgcacaccactttagtccaatgttcttacacgactttgaaacttc

SEQ ID NO: 2338 - DNA, 100 bp, Artificial Sequence
  Synthetic
ccataatcttgcacgggtcgtcatccgaggacgaaatggaagtggattaccctgttgttagcacacatgaacaaattgccagtagcccaccaggagataa

SEQ ID NO: 2339 - DNA, 50 bp, Artificial Sequence
  Synthetic
gtaatccacttccatttcgtcctcggatgacgacccgtgcaagattatgg

SEQ ID NO: 2340 - DNA, 50 bp, Artificial Sequence
  Synthetic
ttatctcctggtgggctactggcaatttgttcatgtgtgctaacaacagg

SEQ ID NO: 2341 - DNA, 100 bp, Artificial Sequence
  Synthetic
tgttctccacgtagacggggagctgtgtgcgagggatattaggtctttgatatttttaagcaaggacactatagggtctcgcagcacaccacagacattc

SEQ ID NO: 2342 - DNA, 50 bp, Artificial Sequence
  Synthetic
tcaaagacctaatatccctcgcacacagctccccgtctacgtggagaaca

SEQ ID NO: 2343 - DNA, 50 bp, Artificial Sequence
  Synthetic
gaatgtctgtggtgtgctgcgagaccctatagtgtccttgcttaaaaata

SEQ ID NO: 2344 - DNA, 100 bp, Artificial Sequence
  Synthetic
atcacaggcttaatgcgagacaaggagtctttattcgaggccatgttggctaatgtgagatttcacagcaccaccggtataaaccagcttgggttgagca

SEQ ID NO: 2345 - DNA, 50 bp, Artificial Sequence
  Synthetic
gccaacatggcctcgaataaagactccttgtctcgcattaagcctgtgat

SEQ ID NO: 2346 - DNA, 50 bp, Artificial Sequence
  Synthetic
tgctcaacccaagctggtttataccggtggtgctgtgaaatctcacatta

SEQ ID NO: 2347 - DNA, 100 bp, Artificial Sequence
  Synthetic
attagcgcatgcaaattagctttgccgaagttctcggaaagccggtggggcgcgctggatttttggaccgtgggaaatgggaccggtgtcctctctatga

SEQ ID NO: 2348 - DNA, 50 bp, Artificial Sequence
  Synthetic
ccccaccggctttccgagaacttcggcaaagctaatttgcatgcgctaat

SEQ ID NO: 2349 - DNA, 50 bp, Artificial Sequence
  Synthetic
tcatagagaggacaccggtcccatttcccacggtccaaaaatccagcgcg

SEQ ID NO: 2350 - DNA, 100 bp, Artificial Sequence
  Synthetic
cgtaccggcatctgcaagggtattctagagcccgctgctatttttcatctgaaactaccagccatcaacgatactgatcactgcgggttaataggattta

SEQ ID NO: 2351 - DNA, 50 bp, Artificial Sequence
  Synthetic
agatgaaaaatagcagcgggctctagaatacccttgcagatgccggtacg

SEQ ID NO: 2352 - DNA, 50 bp, Artificial Sequence
  Synthetic
taaatcctattaacccgcagtgatcagtatcgttgatggctggtagtttc

SEQ ID NO: 2353 - DNA, 100 bp, Artificial Sequence
  Synthetic
tcggattcatccttgccaatatcctggtattgcaacgatactcggctttggcgactgacgaagccaacactcactattgacatcattacctgcaatttta

SEQ ID NO: 2354 - DNA, 50 bp, Artificial Sequence
  Synthetic
caaagccgagtatcgttgcaataccaggatattggcaaggatgaatccga

SEQ ID NO: 2355 - DNA, 50 bp, Artificial Sequence
  Synthetic
taaaattgcaggtaatgatgtcaatagtgagtgttggcttcgtcagtcgc

SEQ ID NO: 2356 - DNA, 100 bp, Artificial Sequence
  Synthetic
tgtagccacccgtcccgggtacaagtcccgggtggtgaggacggtgtctgtggttgtcttcccagactctgctttctgccgtcttcggtcaagtaccagc

SEQ ID NO: 2357 - DNA, 35 bp, Artificial Sequence
  Synthetic
cagacaccgtcctcaccacccgggacttgtacccg

SEQ ID NO: 2358 - DNA, 50 bp, Artificial Sequence
  Synthetic
gctggtacttgaccgaagacggcagaaagcagagtctgggaagacaacca

SEQ ID NO: 2359 - DNA, 100 bp, Artificial Sequence
  Synthetic
gtcccgggggaggagaagagaggcttcccgcctagagcatttgcaagtcaggattctctaatccctctgggagaagggtattcggcttgtccgctatttt

SEQ ID NO: 2360 - DNA, 41 bp, Artificial Sequence
  Synthetic
tgacttgcaaatgctctaggcgggaagcctctcttctcctc

SEQ ID NO: 2361 - DNA, 50 bp, Artificial Sequence
  Synthetic
aaaatagcggacaagccgaatacccttctcccagagggattagagaatcc

SEQ ID NO: 2362 - DNA, 100 bp, Artificial Sequence
  Synthetic
tcttgattcttcaaaagcattctgagaaggtgagataagccctgagtctcagctacctaagaaaaacctggatgtcactggccactgaggagctttgttt

SEQ ID NO: 2363 - DNA, 50 bp, Artificial Sequence
  Synthetic
gagactcagggcttatctcaccttctcagaatgcttttgaagaatcaaga

SEQ ID NO: 2364 - DNA, 50 bp, Artificial Sequence
  Synthetic
aaacaaagctcctcagtggccagtgacatccaggtttttcttaggtagct

SEQ ID NO: 2365 - DNA, 100 bp, Artificial Sequence
  Synthetic
tggccttctttgagttcggtggggtcatgtgtgtggagagcgtcaaccgggagatgtcgcccctggtggacaacatcgccctgtggatgactgagtacct

SEQ ID NO: 2366 - DNA, 50 bp, Artificial Sequence
  Synthetic
ccggttgacgctctccacacacatgaccccaccgaactcaaagaaggcca

SEQ ID NO: 2367 - DNA, 35 bp, Artificial Sequence
  Synthetic
cacagggcgatgttgtccaccaggggcgacatctc

SEQ ID NO: 2368 - DNA, 100 bp, Artificial Sequence
  Synthetic
attctgcaacactgtacacataaaaaatacggtaaggatactttacatggttaaggtaaagtaagtctccagttggccaccattagctataatggcactt

SEQ ID NO: 2369 - DNA, 50 bp, Artificial Sequence
  Synthetic
ccatgtaaagtatccttaccgtattttttatgtgtacagtgttgcagaat

SEQ ID NO: 2370 - DNA, 50 bp, Artificial Sequence
  Synthetic
aagtgccattatagctaatggtggccaactggagacttactttaccttaa

SEQ ID NO: 2371 - DNA, 100 bp, Artificial Sequence
  Synthetic
gaacttgaggaagtgaacatttcggtgacttccgcatcaggaaggctagagttacccagagcatcaggccgccacaagtgcctgcttttaggagaccgaa

SEQ ID NO: 2372 - DNA, 50 bp, Artificial Sequence
  Synthetic
tctagccttcctgatgcggaagtcaccgaaatgttcacttcctcaagttc

SEQ ID NO: 2373 - DNA, 45 bp, Artificial Sequence
  Synthetic
tctcctaaaagcaggcacttgtggcggcctgatgctctgggtaac

SEQ ID NO: 2374 - DNA, 100 bp, Artificial Sequence
  Synthetic
tcagggagttggaagttttcagaataaccagaactaagggtatgaaggacctgtattggggtcgatgtgatgcctctgcgaagaaccttgtgtgacaaat

SEQ ID NO: 2375 - DNA, 50 bp, Artificial Sequence
  Synthetic
gtccttcatacccttagttctggttattctgaaaacttccaactccctga

SEQ ID NO: 2376 - DNA, 50 bp, Artificial Sequence
  Synthetic
atttgtcacacaaggttcttcgcagaggcatcacatcgaccccaatacag

SEQ ID NO: 2377 - DNA, 100 bp, Artificial Sequence
  Synthetic
cggccccagcatgcggcctctgtttgatttctcctggctgtctctgaagactctgctcagtttggccctggtgggagcttgcatcaccctgggtgcctat

SEQ ID NO: 2378 - DNA, 50 bp, Artificial Sequence
  Synthetic
tcttcagagacagccaggagaaatcaaacagaggccgcatgctggggccg

SEQ ID NO: 2379 - DNA, 40 bp, Artificial Sequence
  Synthetic
agggtgatgcaagctcccaccagggccaaactgagcagag

SEQ ID NO: 2380 - DNA, 100 bp, Artificial Sequence
  Synthetic
tgctaatttaaagagactccaaatctcaatgaagccagctcacagtgctgtgtgccccggtcacctagcaagctgccgaaccaaaagaatttgcaccccg

SEQ ID NO: 2381 - DNA, 50 bp, Artificial Sequence
  Synthetic
cagcactgtgagctggcttcattgagatttggagtctctttaaattagca

SEQ ID NO: 2382 - DNA, 45 bp, Artificial Sequence
  Synthetic
tgcaaattcttttggttcggcagcttgctaggtgaccggggcaca

SEQ ID NO: 2383 - DNA, 100 bp, Artificial Sequence
  Synthetic
cgcgccggtgtccccagagaccaggctgtgtccctcttctcttccctgcgcctgtgatgctgggcacttcatctgatcgggggcgtagcatcatagtagt

SEQ ID NO: 2384 - DNA, 45 bp, Artificial Sequence
  Synthetic
cgcagggaagagaagagggacacagcctggtctctggggacaccg

SEQ ID NO: 2385 - DNA, 50 bp, Artificial Sequence
  Synthetic
actactatgatgctacgcccccgatcagatgaagtgcccagcatcacagg

SEQ ID NO: 2386 - DNA, 100 bp, Artificial Sequence
  Synthetic
attgattcagcctgtttggcgtttcccagagtcatctgattggacaggcatgggtgcaaggaaaattagggtactcaacctaagttcggttccgatgaat

SEQ ID NO: 2387 - DNA, 50 bp, Artificial Sequence
  Synthetic
tgcctgtccaatcagatgactctgggaaacgccaaacaggctgaatcaat

SEQ ID NO: 2388 - DNA, 50 bp, Artificial Sequence
  Synthetic
attcatcggaaccgaacttaggttgagtaccctaattttccttgcaccca

SEQ ID NO: 2389 - DNA, 100 bp, Artificial Sequence
  Synthetic
gttgtgtgtgcagggagggcagttttctaatggaatggtttgggaatatccatgtacttgtttgcaagcaggactttgaggcaagtgtgggccactgtgg

SEQ ID NO: 2390 - DNA, 50 bp, Artificial Sequence
  Synthetic
gatattcccaaaccattccattagaaaactgccctccctgcacacacaac

SEQ ID NO: 2391 - DNA, 50 bp, Artificial Sequence
  Synthetic
ccacagtggcccacacttgcctcaaagtcctgcttgcaaacaagtacatg

SEQ ID NO: 2392 - DNA, 100 bp, Artificial Sequence
  Synthetic
tcatggctgaagtcacctcttggttacagtagcgtagcgtggccgtgtgcatgtcctttgcgcctgtgaccaccaccccaacaaaccatccagtgacaaa

SEQ ID NO: 2393 - DNA, 50 bp, Artificial Sequence
  Synthetic
gcacacggccacgctacgctactgtaaccaagaggtgacttcagccatga

SEQ ID NO: 2394 - DNA, 45 bp, Artificial Sequence
  Synthetic
cactggatggtttgttggggtggtggtcacaggcgcaaaggacat

SEQ ID NO: 2395 - DNA, 100 bp, Artificial Sequence
  Synthetic
gcactcacgccctaagcgcacattcatgtgggcatttcttgcgagcctcgcagcctccggaagctgtcgacttcatgacaagcattttgtgaactaggga

SEQ ID NO: 2396 - DNA, 50 bp, Artificial Sequence
  Synthetic
cgaggctcgcaagaaatgcccacatgaatgtgcgcttagggcgtgagtgc

SEQ ID NO: 2397 - DNA, 50 bp, Artificial Sequence
  Synthetic
tccctagttcacaaaatgcttgtcatgaagtcgacagcttccggaggctg

SEQ ID NO: 2398 - DNA, 100 bp, Artificial Sequence
  Synthetic
aaagataccgcggtccctccagaggatttgagggacagggtcggagggggctcttccgccagcaccggaggaagaaagaggaggggctggctggtcacca

SEQ ID NO: 2399 - DNA, 35 bp, Artificial Sequence
  Synthetic
ccccctccgaccctgtccctcaaatcctctggagg

SEQ ID NO: 2400 - DNA, 35 bp, Artificial Sequence
  Synthetic
ccctcctctttcttcctccggtgctggcggaagag

SEQ ID NO: 2401 - DNA, 100 bp, Artificial Sequence; identical to SEQ ID NO: 136
  Synthetic

SEQ ID NO: 2402 - DNA, 50 bp, Artificial Sequence; identical to SEQ ID NO: 137
  Synthetic

SEQ ID NO: 2403 - DNA, 50 bp, Artificial Sequence; identical to SEQ ID NO: 138
  Synthetic

SEQ ID NO: 2404 - DNA, 100 bp, Artificial Sequence; identical to SEQ ID NO: 295
  Synthetic

SEQ ID NO: 2405 - DNA, 50 bp, Artificial Sequence; identical to SEQ ID NO: 296
  Synthetic

SEQ ID NO: 2406 - DNA, 50 bp, Artificial Sequence; identical to SEQ ID NO: 297
  Synthetic

SEQ ID NO: 2407 - DNA, 100 bp, Artificial Sequence; identical to SEQ ID NO: 475
  Synthetic

SEQ ID NO: 2408 - DNA, 43 bp, Artificial Sequence; identical to SEQ ID NO: 476
  Synthetic

SEQ ID NO: 2409 - DNA, 50 bp, Artificial Sequence; identical to SEQ ID NO: 477
  Synthetic

SEQ ID NO: 2410 - DNA, 100 bp, Artificial Sequence; identical to SEQ ID NO: 520
  Synthetic

SEQ ID NO: 2411 - DNA, 50 bp, Artificial Sequence; identical to SEQ ID NO: 521
  Synthetic

SEQ ID NO: 2412 - DNA, 50 bp, Artificial Sequence; identical to SEQ ID NO: 522
  Synthetic

SEQ ID NO: 2413 - DNA, 100 bp, Artificial Sequence; identical to SEQ ID NO: 1033
  Synthetic

SEQ ID NO: 2414 - DNA, 50 bp, Artificial Sequence; identical to SEQ ID NO: 1034
  Synthetic

SEQ ID NO: 2415 - DNA, 38 bp, Artificial Sequence; identical to SEQ ID NO: 1035
  Synthetic

SEQ ID NO: 2416 - DNA, 100 bp, Artificial Sequence; identical to SEQ ID NO: 1039
  Synthetic

SEQ ID NO: 2417 - DNA, 50 bp, Artificial Sequence; identical to SEQ ID NO: 1040
  Synthetic

SEQ ID NO: 2418 - DNA, 40 bp, Artificial Sequence; identical to SEQ ID NO: 1041
  Synthetic

SEQ ID NO: 2419 - DNA, 100 bp, Artificial Sequence; identical to SEQ ID NO: 1054
  Synthetic

SEQ ID NO: 2420 - DNA, 50 bp, Artificial Sequence; identical to SEQ ID NO: 1055
  Synthetic

SEQ ID NO: 2421 - DNA, 50 bp, Artificial Sequence; identical to SEQ ID NO: 1056
  Synthetic

SEQ ID NO: 2422 - DNA, 100 bp, Artificial Sequence; identical to SEQ ID NO: 1162
  Synthetic

SEQ ID NO: 2423 - DNA, 50 bp, Artificial Sequence; identical to SEQ ID NO: 1163
  Synthetic

SEQ ID NO: 2424 - DNA, 49 bp, Artificial Sequence; identical to SEQ ID NO: 1164
  Synthetic

SEQ ID NO: 2425 - DNA, 100 bp, Artificial Sequence; identical to SEQ ID NO: 1213
  Synthetic

SEQ ID NO: 2426 - DNA, 50 bp, Artificial Sequence; identical to SEQ ID NO: 1214
  Synthetic

SEQ ID NO: 2427 - DNA, 50 bp, Artificial Sequence; identical to SEQ ID NO: 1215
  Synthetic

SEQ ID NO: 2428 - DNA, 100 bp, Artificial Sequence; identical to SEQ ID NO: 1282
  Synthetic

SEQ ID NO: 2429 - DNA, 50 bp, Artificial Sequence; identical to SEQ ID NO: 1283
  Synthetic

SEQ ID NO: 2430 - DNA, 50 bp, Artificial Sequence; identical to SEQ ID NO: 1284
  Synthetic

SEQ ID NO: 2431 - DNA, 100 bp, Artificial Sequence; identical to SEQ ID NO: 1327
  Synthetic

SEQ ID NO: 2432 - DNA, 50 bp, Artificial Sequence; identical to SEQ ID NO: 1328
  Synthetic

SEQ ID NO: 2433 - DNA, 50 bp, Artificial Sequence; identical to SEQ ID NO: 1329
  Synthetic

SEQ ID NO: 2434 - DNA, 100 bp, Artificial Sequence; identical to SEQ ID NO: 1519
  Synthetic

SEQ ID NO: 2435 - DNA, 48 bp, Artificial Sequence; identical to SEQ ID NO: 1520
  Synthetic

SEQ ID NO: 2436 - DNA, 50 bp, Artificial Sequence; identical to SEQ ID NO: 1521
  Synthetic

SEQ ID NO: 2437 - DNA, 100 bp, Artificial Sequence; identical to SEQ ID NO: 1639
  Synthetic

SEQ ID NO: 2438 - DNA, 50 bp, Artificial Sequence; identical to SEQ ID NO: 1640
  Synthetic

SEQ ID NO: 2439 - DNA, 50 bp, Artificial Sequence; identical to SEQ ID NO: 1641
  Synthetic

SEQ ID NO: 2440 - DNA, 100 bp, Artificial Sequence; identical to SEQ ID NO: 1654
  Synthetic

SEQ ID NO: 2441 - DNA, 50 bp, Artificial Sequence; identical to SEQ ID NO: 1655
  Synthetic

SEQ ID NO: 2442 - DNA, 49 bp, Artificial Sequence; identical to SEQ ID NO: 1656
  Synthetic

SEQ ID NO: 2443 - DNA, 100 bp, Artificial Sequence; identical to SEQ ID NO: 1744
  Synthetic

SEQ ID NO: 2444 - DNA, 45 bp, Artificial Sequence; identical to SEQ ID NO: 1745
  Synthetic

SEQ ID NO: 2445 - DNA, 50 bp, Artificial Sequence; identical to SEQ ID NO: 1746
  Synthetic

SEQ ID NO: 2446 - DNA, 100 bp, Artificial Sequence; identical to SEQ ID NO: 1783
  Synthetic

SEQ ID NO: 2447 - DNA, 47 bp, Artificial Sequence; identical to SEQ ID NO: 1784
  Synthetic

SEQ ID NO: 2448 - DNA, 50 bp, Artificial Sequence; identical to SEQ ID NO: 1785
  Synthetic

SEQ ID NO: 2449 - DNA, 100 bp, Artificial Sequence; identical to SEQ ID NO: 2086
  Synthetic

SEQ ID NO: 2450 - DNA, 50 bp, Artificial Sequence; identical to SEQ ID NO: 2087
  Synthetic

SEQ ID NO: 2451 - DNA, 42 bp, Artificial Sequence; identical to SEQ ID NO: 2088
  Synthetic

SEQ ID NO: 2452 - DNA, 100 bp, Artificial Sequence; identical to SEQ ID NO: 2131
  Synthetic

SEQ ID NO: 2453 - DNA, 46 bp, Artificial Sequence; identical to SEQ ID NO: 2132
  Synthetic

SEQ ID NO: 2454 - DNA, 47 bp, Artificial Sequence; identical to SEQ ID NO: 2133
  Synthetic

SEQ ID NO: 2455 - DNA, 100 bp, Artificial Sequence; identical to SEQ ID NO: 2170
  Synthetic

SEQ ID NO: 2456 - DNA, 42 bp, Artificial Sequence; identical to SEQ ID NO: 2171
  Synthetic

SEQ ID NO: 2457 - DNA, 50 bp, Artificial Sequence; identical to SEQ ID NO: 2172
  Synthetic

SEQ ID NO: 2458 - DNA, 100 bp, Artificial Sequence; identical to SEQ ID NO: 2209
  Synthetic

SEQ ID NO: 2459 - DNA, 46 bp, Artificial Sequence; identical to SEQ ID NO: 2210
  Synthetic

SEQ ID NO: 2460 - DNA, 45 bp, Artificial Sequence; identical to SEQ ID NO: 2211
  Synthetic

The invention claimed is:

1. A method for treating an activated B cell-like diffuse large B cell lymphoma (ABC DLBCL) in a human subject, a germinal center B cell-like diffuse large B cell lymphoma (GCB DLBCL) in a human subject, a primary mediastinal B cell lymphoma (PMBL) in a human subject, a Burkitt lymphoma (BL) in a human subject, or a mantle cell lymphoma (MCL) in a human subject, the method comprising:
   (a) isolating RNA gene expression product from a biopsy sample from a lymphoma human subject;
   (b) obtaining digital gene expression data from the isolated gene expression product, wherein the digital gene expression data comprises data for genes in a gene expression signature, and wherein the gene expression signature comprises each of the genes below:

| Gene | GenBank Accession No. |
| --- | --- |
| ACSL5 | NM_016234.3 |
| ADAM12 | NM_003474.4 |
| AHCYL2 | NM_001130723.2 |
| AHR | NM_001621.3 |
| AKAP2 | NM_001136562.2 |
| AKAP9 | NM_005751.3 |
| ALOX5 | NM_000698.2 |
| ANKRD13A | NM_033121.1 |
| ANTXR1 | NM_018153.3 |
| ARID3A | NM_005224.2 |
| ARID3B | NM_006465.2 |
| ASB13 | NM_024701.3 |
| ATXN7L2 | NM_153340.4 |
| AUH | NM_001698.2 |
| AUTS2 | NM_001127231.1 |
| BANK1 | NM_001083907.1 |
| BATF | NM_006399.3 |
| BCAT1 | NM_005504.4 |
| BCL2 | NM_053056.2 |
| BCL2A1 | NM_004049.2 |
| BCL2L10 | NM_020396.2 |
| BCL6 | NM_001706.2 |
| BIRC3 | NM_001165.3 |
| BPGM | NM_199186.1 |
| BPNT1 | NM_006085.4 |
| BSPRY | NM_017688.2 |
| BUB1B | NM_001211.4 |
| C10orf18 | NM_017782.3 |
| C13orf18 | NM_025113.2 |
| C3orf37 | NM_020187.2 |
| CALD1 | NM_033138.2 |
| CARD11 | NM_032415.2 |
| CCDC50 | NM_174908.3 |
| CCL17 | NM_002987.2 |
| CCND1 | NM_053056.2 |
| CCND2 | NM_001759.2 |
| CCR7 | NM_001838.2 |
| CD44 | NM_000610.3 |
| CDH11 | NM_001797.2 |
| CDK5RAP2 | NM_001011649.1 |
| CDK6 | NM_001259.5 |
| CFLAR | NM_003879.3 |
| CGNL1 | NM_032866.3 |
| CHD4 | NM_001273.2 |
| CLIP2 | NM_003388.4 |
| CPA6 | NM_001127445.1 |
| CPNE3 | NM_003909.2 |
| CR2 | NM_001006658.1 |
| CREB3L2 | NM_194071.2 |
| CSF2RA | NM_006140.3 |
| CSTA | NM_005213.3 |
| CTHRC1 | NM_138455.2 |
| CTSH | NM_148979.2 |
| CTSK | NM_000396.2 |
| CYB5R2 | NM_016229.3 |
| CYP27A1 | NM_000784.3 |
| DAZAP2 | NM_014764.3 |
| DCTD | NM_001012732.1 |
| DENND4A | NM_005848.3 |
| DNAJB12 | NM_017626.4 |
| DNAJC10 | NM_018981.1 |
| DOCK10 | NM_014689.1 |
| DPYSL3 | NM_001387.2 |
| E2F2 | NM_004091.2 |
| EEPD1 | NM_030636.2 |
| EFEMP2 | NM_016938.3 |
| ELL2 | NM_012081.5 |
| EML1 | NM_004434.2 |
| ENTPD1 | NM_001776.4 |
| ERBB2IP | NM_018695.2 |
| ERP29 | NM_001034025.1 |
| ETV6 | NM_001987.4 |
| FAM108C1 | NM_021214.1 |
| FAM159A | NM_001042693.1 |
| FAM171B | NM_177454.3 |
| FAM46C | NM_017709.3 |
| FAM69A | NM_001006605.3 |
| FAP | NM_004460.2 |
| FAS | NM_000043.3 |
| FBXO41 | NM_001080410.1 |

-continued

| Gene | GenBank Accession No. |
|---|---|
| FCER2 | NM_002002.4 |
| FKBP11 | NM_016594.2 |
| FLJ42418 | NM_001001695.1 |
| FN1 | NM_212482.1 |
| FNDC1 | NM_032532.2 |
| FUT8 | NM_004480.3 |
| GCET2 | NM_001008756.1 |
| GIT2 | NM_057169.2 |
| GNA13 | NM_006572.4 |
| GNL3 | NM_014366.4 |
| GORASP1 | NM_031899.2 |
| GSK3B | NM_002093.2 |
| GYPC | NM_016815.2 |
| HARBI1 | NM_173811.3 |
| HCK | NM_002110.2 |
| HDAC1 | NM_004964.2 |
| HDGF | NM_004494.2 |
| HEG1 | NM_020733.1 |
| HLA-DMA | NM_006120.3 |
| HOMER2 | NM_004839.2 |
| HOPX | NM_001145460.1 |
| HPCAL1 | NM_134421.1 |
| HSP90AA1 | NM_005348.3 |
| HSP90B1 | NM_003299.1 |
| HSPA9 | NM_004134.4 |
| HSPB8 | NM_014365.2 |
| HTRA1 | NM_002775.4 |
| ICAM1 | NM_000201.1 |
| IFIH1 | NM_022168.2 |
| IGSF3 | NM_001542.2 |
| IK | NM_006083.3 |
| IL12A | NM_000882.2 |
| IL13RA1 | NM_001560.2 |
| IL16 | NM_004513.4 |
| IL17RB | NM_018725.3 |
| IRF4 | NM_002460.1 |
| ISG15 | NM_005101.3 |
| ISY1 | NM_020701.2 |
| ITGAV | NM_002210.2 |
| ITGAX | NM_000887.3 |
| ITGB2 | NM_000211.2 |
| ITPKB | NM_002221.3 |
| JAK2 | NM_004972.2 |
| JAK3 | NM_000215.2 |
| KCNK12 | NM_022055.1 |
| KIAA0746 | NM_015187.3 |
| KIAA1274 | NM_014431.2 |
| KLHL5 | NM_015990.4 |
| KRAS | NM_033360.2 |
| KYNU | NM_003937.2 |
| LANCL1 | NM_006055.1 |
| LDHA | NM_005566.1 |
| LIMA1 | NM_001113547.1 |
| LIMD1 | NM_014240.2 |
| LMO2 | NM_005574.3 |
| LRMP | NM_006152.2 |
| LRRC15 | NM_001135057.2 |
| LRRC33 | NM_198565.1 |
| LTBP2 | NM_000428.2 |
| LYPD6B | NM_177964.3 |
| LYZ | NM_000239.2 |
| MAL | NM_002371.2 |
| MAML3 | NM_018717.4 |
| MAP3K1 | NM_005921.1 |
| MAP4K4 | NM_004834.3 |
| MAPK10 | NM_002753.2 |
| MARCKSL1 | NM_023009.5 |
| MAST2 | NM_015112.1 |
| MDFIC | NM_199072.2 |
| MLL2 | NM_003482.3 |
| MLLT10 | NM_004641.2 |
| MME | NM_000902.2 |
| MMP2 | NM_004530.2 |
| MMP9 | NM_004994.2 |
| MOBKL2C | NM_145279.4 |
| MPEG1 | XM_937323.1 |
| MTHFD2 | NM_006636.3 |
| MYB | NM_005375.2 |
| MYBL1 | XM_034274.14 |
| MYC | NM_002467.3 |
| NAIF1 | NM_197956.3 |
| NANS | NM_018946.3 |
| NCF2 | NM_000433.2 |
| NECAP2 | NM_018090.4 |
| NEIL1 | NM_024608.2 |
| NEK6 | NM_014397.3 |
| NEU3 | NM_006656.5 |
| NFIL3 | NM_005384.2 |
| NFKBIZ | NM_001005474.1 |
| NIPA2 | NM_001008860.1 |
| NOC3L | NM_022451.9 |
| NOL5A | NM_006392.2 |
| NP | NM_000270.3 |
| OPA1 | NM_130837.1 |
| OSBPL3 | NM_145320.1 |
| PAG1 | NM_018440.3 |
| PDE9A | NM_001001567.1 |
| PDIA5 | NM_006810.2 |
| PDLIM1 | NM_020992.2 |
| PDPN | NM_006474.4 |
| PFTK1 | NM_012395.2 |
| PHF16 | NM_014735.3 |
| PHF23 | NM_024297.2 |
| PIM1 | NM_002648.2 |
| PIM2 | NM_006875.2 |
| PLAU | NM_002658.2 |
| PLEK | NM_002664.2 |
| PLEKHF2 | NM_024613.2 |
| PMEPA1 | NM_020182.3 |
| PPA1 | NM_021129.3 |
| PPP3CC | NM_005605.3 |
| PRDX2 | NM_005809.4 |
| PRICKLE1 | NM_153026.1 |
| PRKCB | NM_212535.1 |
| PRPSAP2 | NM_002767.2 |
| PRR6 | NM_181716.2 |
| PTGIR | NM_000960.3 |
| PTK2 | NM_005607.3 |
| PTPN1 | NM_002827.2 |
| PTRH1 | NM_001002913.1 |
| R3HDM1 | NM_015361.2 |
| RAB20 | NM_017817.1 |
| RAB33A | NM_004794.2 |
| RAB7L1 | NM_001135664.1 |
| RANBP9 | NM_005493.2 |
| RAPGEF5 | NM_012294.3 |
| RARRES2 | NM_002889.3 |
| RASGRP3 | NM_015376.2 |
| RC3H2 | NM_018835.2 |
| RCL1 | NM_005772.3 |
| REL | NM_002908.2 |
| RFTN1 | NM_015150.1 |
| RGS9 | NM_003835.1 |
| RHOF | NM_019034.2 |
| RNF214 | NM_207343.2 |
| RNUXA | NM_032177.3 |
| ROBO1 | NM_002941.2 |
| RRP1B | NM_015056.2 |
| S100Z | NM_130772.3 |
| S1PR2 | NM_004230.2 |
| SACS | NM_014363.4 |
| SAMSN1 | NM_022136.3 |
| SCARA5 | NM_173833.4 |
| SERPINA9 | NM_001042518.1 |
| SGK1 | NM_005627.2 |
| SH3BP5 | NM_001018009.2 |
| SIDT1 | NM_017699.2 |
| SLA | NM_001045556.2 |
| SLAMF1 | NM_003037.2 |
| SLC38A5 | NM_033518.2 |
| SMARCA4 | NM_003072.3 |
| SNN | NM_003498.4 |
| SNX11 | NM_152244.1 |
| SNX22 | NM_024798.2 |

-continued

| Gene | GenBank Accession No. |
|---|---|
| SNX29 | NM_001080530.2 |
| SOX11 | NM_003108.3 |
| SPARC | NM_003118.2 |
| SPINK2 | NM_021114.2 |
| SPINT2 | NM_021102.2 |
| SPRED2 | NM_181784.2 |
| SSBP2 | NM_012446.2 |
| STAMBPL1 | NM_020799.2 |
| STAP1 | NM_012108.2 |
| STAT3 | NM_139276.2 |
| STK17A | NM_004760.1 |
| STS | NM_000351.4 |
| STX11 | NM_003764.3 |
| SUFU | NM_016169.2 |
| SULF1 | NM_015170.2 |
| TARS | NM_152295.3 |
| TBC1D9 | NM_015130.2 |
| TCF3 | NM_003200.2 |
| TCF4 | NM_001083962.1 |
| TCTN3 | NM_015631.5 |
| TERT | NM_198253.1 |
| TEX9 | NM_198524.1 |
| THBS2 | NM_003247.2 |
| THOC5 | NM_001002878.1 |
| THY1 | NM_006288.2 |
| TIAM2 | NM_001010927.2 |
| TICAM2 | NM_021649.4 |
| TLE4 | NM_007005.3 |
| TLK1 | NM_012290.3 |
| TLR7 | NM_016562.3 |
| TMEM119 | NM_181724.2 |
| TMOD1 | NM_003275.2 |
| TNFRSF13B | NM_012452.2 |
| TNFRSF17 | NM_001192.2 |
| TNFSF4 | NM_003326.2 |
| TOX | NM_014729.2 |
| TPM1 | NM_000366.5 |
| TRAF1 | NM_005658.3 |
| TRIM56 | NM_030961.1 |
| TRIM62 | NM_018207.2 |
| TRIP13 | NM_004237.2 |
| TTC9 | NM_015351.1 |
| TUBB2C | NM_006088.5 |
| UBXN4 | NM_014607.3 |
| USP12 | NM_182488.3 |
| USP46 | NM_022832.2 |
| VAC14 | NM_018052.3 |
| VASH2 | NM_024749.3 |
| VGLL4 | NM_001128220.1 |
| VRK3 | NM_016440.3 |
| WAC | NM_100486.2 |
| WDR55 | NM_017706.4 |
| WNT3 | NM_030753.3 |
| XBP1 | NM_005080.2 |
| ZBTB32 | NM_014383.1 |
| ZBTB37 | NM_001122770.1 |
| ZBTB8 | NM_001040441.1 |
| ZCCHC2 | NM_017742.4 |
| ZCCHC7 | NM_032226.2 |
| ZNF281 | NM_012482.3 |
| ZNF318 | NM_014345.2 |
| ZNF598 | NM_178167.2 |
| ZNF608 | NM_020747.2; |

(c) optionally obtaining digital gene expression data from a first and second reference set of probe sets, the first and second reference set of probe sets being known for classifying ABC DLBCL, GCB DLBCL, PMBL, BL, or MCL;

(d) calculating a predictor score using an equation:

$$y_i = \log_2(x_i) - \sum_j \log_2(x_j) h_j - \log_2(r_i) + \log_2(g_i)$$

wherein $y_i$ is a predictor score for gene i, $x_i$ is the counts for probe set i for gene i on the sample being tested, $x_j$ is the counts for probe set j for gene j, probe set j is the set of normalization genes of the sample being tested, $h_j$ is the normalization weight for probe set j as listed below:

| Gene | Normalization weights |
|---|---|
| ACPP | 0 |
| ACTG2 | 0 |
| ADAM12 | 0 |
| ADAM28 | 0 |
| ADH1B | 0 |
| ADIPOQ | 0 |
| ADO | 0 |
| AHR | 0 |
| AICDA | 0 |
| AKAP2 | 0 |
| AKR1C2 | 0 |
| ALOX5 | 0 |
| AMIGO2 | 0 |
| ANKRD13A | 0 |
| ANLN | 0 |
| ANO3 | 0 |
| ANTXR1 | 0 |
| ANUBL1 | 0 |
| APOL1 | 0 |
| ARID3A | 0 |
| ARID3B | 0 |
| ARID5A | 0 |
| ARL6IP1 | 0 |
| ARNT2 | 0 |
| ARNTL | 0 |
| ASB13 | 0 |
| ASPM | 0 |
| ATF3 | 0 |
| ATM | 0 |
| ATP6V0E1 | 0 |
| AUH | 0 |
| AURKA | 0 |
| AUTS2 | 0 |
| BANK1 | 0 |
| BASP1 | 0 |
| BATF | 0 |
| BATF3 | 0 |
| BCAT1 | 0 |
| BCL10 | 0 |
| BCL2 | 0 |
| BCL2 | 0 |
| BCL2 | 0 |
| BCL2 | 0 |
| BCL2 | 0 |
| BCL2 | 0 |
| BCL2A1 | 0 |
| BCL2L10 | 0 |
| BCL6 | 0 |
| BEST3 | 0 |
| BIRC2 | 0 |
| BIRC3 | 0 |
| BIRC5 | 0 |
| BMP7 | 0 |
| BPGM | 0 |
| BPNT1 | 0 |
| BSPRY | 0 |
| BST2 | 0 |
| BTBD19 | 0 |
| BTG1 | 0 |
| BTG2 | 0 |
| BTK | 0 |
| BUB1 | 0 |

-continued

| Gene | Normalization weights |
|---|---|
| BUB1B | 0 |
| C10orf18 | 0 |
| C13orf18 | 0 |
| C15orf41 | 0 |
| C3orf37 | 0 |
| C5AR1 | 0 |
| C5orf41 | 0 |
| C7orf68 | 0 |
| CACNA1D | 0 |
| CALD1 | 0 |
| CAMK2B | 0 |
| CARD11 | 0 |
| CAV1 | 0 |
| CAV2 | 0 |
| CCDC50 | 0 |
| CCDC75 | 0 |
| CCL17 | 0 |
| CCNA2 | 0 |
| CCNB1 | 0 |
| CCNB2 | 0 |
| CCND1 | 0 |
| CCND1 | 0 |
| CCND1 | 0 |
| CCND1 | 0 |
| CCND1 | 0 |
| CCND1 | 0 |
| CCND2 | 0 |
| CCND3 | 0 |
| CCR7 | 0 |
| CD2 | 0 |
| CD200 | 0 |
| CD22 | 0 |
| CD247 | 0 |
| CD274 | 0 |
| CD3D | 0 |
| CD3E | 0 |
| CD3G | 0 |
| CD40 | 0 |
| CD44 | 0 |
| CD47 | 0 |
| CD5 | 0 |
| CD58 | 0 |
| CD6 | 0 |
| CD74 | 0 |
| CD79A | 0 |
| CD79B | 0 |
| CD8A | 0 |
| CD8B | 0 |
| CDC20 | 0 |
| CDC25B | 0 |
| CDC25C | 0 |
| CDCA3 | 0 |
| CDCA5 | 0 |
| CDCA8 | 0 |
| CDH11 | 0 |
| CDC2 | 0 |
| PFTK1 | 0 |
| CDK4 | 0 |
| CDK6 | 0 |
| CDKN2A | 0 |
| CDKN2A | 0 |
| CDKN3 | 0 |
| CELSR1 | 0 |
| CENPA | 0 |
| CENPE | 0 |
| CENPF | 0 |
| CENPN | 0 |
| PRR6 | 0 |
| CEP55 | 0 |
| CFLAR | 0 |
| CGNL1 | 0 |
| CIITA | 0 |
| CKS2 | 0 |
| CLIP2 | 0 |
| CLMN | 0 |
| CPNE3 | 0 |

-continued

| Gene | Normalization weights |
|---|---|
| CR2 | 0 |
| CREB3L2 | 0 |
| CREBBP | 0 |
| CSF2RA | 0 |
| CSTA | 0 |
| CTGF | 0 |
| CTH | 0 |
| CTHRC1 | 0 |
| CTLA4 | 0 |
| CTNNA2 | 0 |
| CTPS | 0 |
| CTSH | 0 |
| CTSK | 0 |
| CXCL10 | 0 |
| CXCL12 | 0 |
| CXCL9 | 0 |
| CYB5R2 | 0 |
| CYP27A1 | 0 |
| CYP2J2 | 0 |
| CYSLTR1 | 0 |
| DCBLD1 | 0 |
| DCTD | 0 |
| DDAH2 | 0 |
| DDX58 | 0 |
| DENND4A | 0 |
| DCL1 | 0 |
| DLEU1 | 0 |
| DLGAP5 | 0 |
| DNAJA1 | 0 |
| DNAJB9 | 0 |
| DNAJC10 | 0 |
| DNMT3A | 0 |
| DOCK10 | 0 |
| DPY19L1 | 0 |
| DPYSL3 | 0 |
| DRAM | 0 |
| DTX1 | 0 |
| E2F2 | 0 |
| E2F8 | 0 |
| EBV_BZLF1 | 0 |
| EBV_EBER1 | 0 |
| EBV_EBER2 | 0 |
| EBV_EBN_A1_CDS | 0 |
| EBV_EBNA2_3'_end | 0 |
| EBV_EBNA2_long | 0 |
| EBV_EBNA3A | 0 |
| EBV_EBNA3B | 0 |
| EBV_EBNA3C | 0 |
| EBV_LMP1_3'_end | 0 |
| EBV_LMP1_unique | 0 |
| EBV_LPM2A | 0 |
| EEPD1 | 0 |
| EFEMP2 | 0 |
| EGFL7 | 0 |
| EHD2 | 0 |
| EIF5AL1 | 0 |
| ELL2 | 0 |
| EML1 | 0 |
| EMR1 | 0 |
| ENO1 | 0 |
| ENPP3 | 0 |
| ENTPD1 | 0 |
| EP300 | 0 |
| EPHB1 | 0 |
| EPSTI1 | 0 |
| ERG | 0 |
| ERP29 | 0 |
| TXNDC4 | 0 |
| ESPL1 | 0 |
| ETV6 | 0 |
| EXO1 | 0 |
| FABP4 | 0 |
| FAM108C1 | 0 |
| FAM159A | 0 |
| FAM171B | 0 |
| FAM46C | 0 |

| Gene | Normalization weights |
|---|---|
| FAM69A | 0 |
| FAM83D | 0 |
| FAP | 0 |
| FAS | 0 |
| FBP2 | 0 |
| FBXO10 | 0 |
| FBXO11 | 0 |
| FCER2 | 0 |
| FEZ1 | 0 |
| FGL2 | 0 |
| FKBP11 | 0 |
| FKBP2 | 0 |
| FLJ42418 | 0 |
| FLNA | 0 |
| FN1 | 0 |
| FNBP1 | 0 |
| FNDC1 | 0 |
| FOXM1 | 0 |
| FOXO1 | 0 |
| FOXP1 | 0 |
| FSCN1 | 0 |
| FUT8 | 0 |
| FYB | 0 |
| GBP1 | 0 |
| GBP4 | 0 |
| GCET2 | 0 |
| GGT1 | 0 |
| GHR | 0 |
| GLDC | 0 |
| GLRX | 0 |
| GNA13 | 0 |
| GNB4 | 0 |
| GNG10 | 0 |
| GNL3 | 0 |
| GPR116 | 0 |
| GPR176 | 0 |
| GPR183 | 0 |
| GRAMD1B | 0 |
| GRB10 | 0 |
| GRSF1 | 0 |
| GTSE1 | 0 |
| GLT8D4 | 0 |
| GYPC | 0 |
| H2AFV | 0 |
| H2AFX | 0 |
| HCK | 0 |
| HDAC1 | 0 |
| HDAC2 | 0 |
| HDGF | 0 |
| HEG1 | 0 |
| HHV8_BCL2 homologue | 0 |
| HHV8_K1-32_Bcb_K1_protein | 0 |
| HHV8_ORF73-LANA | 0 |
| HHV8_T0.7/P6 | 0 |
| HHV8_T1.1 | 0 |
| HHV8_vFLIP_ORF71 | 0 |
| HHV8_vIL6 | 0 |
| HHV8_vMIP1b_ORFK4.2_KIE-3 | 0 |
| HJURP | 0 |
| HLA-A | 0 |
| HLA-B | 0 |
| HLA-C | 0 |
| HLA-DMA | 0 |
| HLA-DPA1 | 0 |
| HLA-DPB1 | 0 |
| HLA-DQA1 | 0 |
| HLA-DRA | 0 |
| HLA-E | 0 |
| HLA-F | 0 |
| HOMER2 | 0 |
| HOPX | 0 |
| HPCAL1 | 0 |
| HSP90B1 | 0 |
| HSPB8 | 0 |
| HTRA1 | 0 |
| HYOU1 | 0 |
| ICAM1 | 0 |
| ID1 | 0 |
| ID2 | 0 |
| ID3 | 0 |
| IDS | 0 |
| IER3 | 0 |
| IFI16 | 0 |
| IFI35 | 0 |
| IFI44L | 0 |
| IFI6 | 0 |
| IFIH1 | 0 |
| IFIT1 | 0 |
| IFIT2 | 0 |
| IFIT3 | 0 |
| IFITM1 | 0 |
| IFNAR1 | 0 |
| IFNAR2 | 0 |
| IFNB1 | 0 |
| IgA2_constant_region | 0 |
| IgE_constant_region | 0 |
| IGFBP5 | 0 |
| IgG2_constant_region | 0 |
| IgG4_constant_region | 0 |
| IGSF3 | 0 |
| IL10 | 0 |
| IL12A | 0 |
| IL13 | 0 |
| IL13RA1 | 0 |
| IL16 | 0 |
| IL17RB | 0 |
| IL4I1 | 0 |
| IL6 | 0 |
| ING1 | 0 |
| INPP5D | 0 |
| IRAK1 | 0 |
| IRAK2 | 0 |
| IRAK3 | 0 |
| IRAK4 | 0 |
| IRF1 | 0 |
| IRF3 | 0 |
| IRF4 | 0 |
| IRF5 | 0 |
| IRF7 | 0 |
| ISG15 | 0 |
| ITGA9 | 0 |
| ITGAV | 0 |
| ITGAX | 0 |
| ITGB2 | 0 |
| ITPKB | 0 |
| JAK1 | 0 |
| JAK2 | 0 |
| JAK3 | 0 |
| KCNJ1 | 0 |
| KCNK12 | 0 |
| KCNMA1 | 0 |
| JMJD2C | 0 |
| KDR | 0 |
| KIAA1147 | 0 |
| KIAA1274 | 0 |
| KIF11 | 0 |
| KIF14 | 0 |
| KIF15 | 0 |
| KIF18A | 0 |
| KIF18B | 0 |
| KIF20A | 0 |
| KIF23 | 0 |
| KIF2C | 0 |
| KIF4A | 0 |
| KLHL5 | 0 |
| KPNA2 | 0 |
| KYNU | 0 |
| LAMB1 | 0 |
| LAMP3 | 0 |
| LANCL1 | 0 |
| LAT | 0 |
| LAT2 | 0 |

| Gene | Normalization weights |
|---|---|
| LDHA | 0 |
| LHFPL3 | 0 |
| LHX2 | 0 |
| LIMA1 | 0 |
| LIMD1 | 0 |
| LMAN2 | 0 |
| LMO2 | 0 |
| LOC643529 | 0 |
| LOXL2 | 0 |
| LPCAT3 | 0 |
| LRMP | 0 |
| LRPPRC | 0 |
| LRRC15 | 0 |
| LRRC33 | 0 |
| LTBP2 | 0 |
| LYPD6B | 0 |
| LYZ | 0 |
| MACROD2 | 0 |
| MAL | 0 |
| MALT1 | 0 |
| MAML3 | 0 |
| MAP3K1 | 0 |
| MAP3K8 | 0 |
| MAP4K4 | 0 |
| MAPK10 | 0 |
| MAPKAPK5 | 0 |
| MARCKS | 0 |
| MARCKSL1 | 0 |
| MAST2 | 0 |
| MATR3 | 0 |
| MCL1 | 0 |
| MCM10 | 0 |
| MCM7 | 0 |
| MDFIC | 0 |
| MDM2 | 0 |
| MFAP5 | 0 |
| MFNG | 0 |
| MFSD2A | 0 |
| MGC87042 | 0 |
| MIR17HG | 0 |
| MKI67 | 0 |
| MME | 0 |
| MMP1 | 0 |
| MMP2 | 0 |
| MMP9 | 0 |
| MMRN2 | 0 |
| MNDA | 0 |
| MOBKL2C | 0 |
| MPEG1 | 0 |
| MS4A1 | 0 |
| MST1R | 0 |
| MTHFD2 | 0 |
| MUC16 | 0 |
| MYB | 0 |
| MYBL1 | 0 |
| MYC | 0 |
| MYD88 | 0 |
| MYO7A | 0 |
| FAM128B | 0 |
| NANS | 0 |
| NASP | 0 |
| NBN | 0 |
| NCAPG | 0 |
| NCAPH | 0 |
| NCF2 | 0 |
| NCRNA00158 | 0 |
| NDST4 | 0 |
| NECAP2 | 0 |
| NEIL1 | 0 |
| NEK6 | 0 |
| NFATC1 | 0 |
| NFIL3 | 0 |
| NFKBIA | 0 |
| NFKBIZ | 0 |
| NIPA2 | 0 |
| NOC3L | 0 |
| NOL14 | 0 |
| NOL5A | 0 |
| NOTCH1 | 0 |
| NOTCH2 | 0 |
| NUF2 | 0 |
| NUP62 | 0 |
| NUSAP1 | 0 |
| OAS2 | 0 |
| OAS3 | 0 |
| OPN3 | 0 |
| OSBPL3 | 0 |
| PA2G4 | 0 |
| PAG1 | 0 |
| DKFZP564O0823 | 0 |
| PAX6 | 0 |
| PCNA | 0 |
| PDCD1LG2 | 0 |
| PDE9A | 0 |
| PDGFRA | 0 |
| PDIA4 | 0 |
| PDIA5 | 0 |
| PDK4 | 0 |
| PDLIM1 | 0 |
| PDLIM3 | 0 |
| PDPN | 0 |
| PECAM1 | 0 |
| PECR | 0 |
| PGAM1 | 0 |
| PHC3 | 0 |
| PHF16 | 0 |
| PIK3CA | 0 |
| PIK3CD | 0 |
| PIM1 | 0 |
| PIM2 | 0 |
| PLAU | 0 |
| PLEK | 0 |
| PLEKHF2 | 0 |
| PLEKHG4B | 0 |
| PLXNB1 | 0 |
| PMEPA1 | 0 |
| PMP22 | 0 |
| NP | 0 |
| POU2AF1 | 0 |
| POU2F1 | 0 |
| POU2F2 | 0 |
| PPA1 | 0 |
| PPP2R3B | 0 |
| FAM152B | 0 |
| PRDM1 | 0 |
| PRDM12 | 0 |
| PRDX2 | 0 |
| PRDX4 | 0 |
| PRICKLE1 | 0 |
| PRKCB | 0 |
| PRMT1 | 0 |
| PRPSAP2 | 0 |
| PRSS1 | 0 |
| PSMG1 | 0 |
| PTEN | 0 |
| PTGER4 | 0 |
| PTGIR | 0 |
| PTK2 | 0 |
| PTPN1 | 0 |
| PTPRB | 0 |
| PVRL1 | 0 |
| PXDN | 0 |
| OSOX1 | 0 |
| RAB31 | 0 |
| RAB33A | 0 |
| RAB3A | 0 |
| RAB7L1 | 0 |
| RAPGEF5 | 0 |
| RARRES2 | 0 |
| RASGRP3 | 0 |
| RASSF4 | 0 |
| RBCK1 | 0 |

| Gene | Normalization weights |
|---|---|
| RCL1 | 0 |
| REL | 0 |
| RFTN1 | 0 |
| RGL1 | 0 |
| RGS9 | 0 |
| RHEBL1 | 0 |
| RHOF | 0 |
| RHOXF1 | 0 |
| RNASEH2B | 0 |
| RNF31 | 0 |
| RNGTT | 0 |
| ROBO1 | 0 |
| ROBO4 | 0 |
| RPN2 | 0 |
| RPS6KA5 | 0 |
| RSAD2 | 0 |
| RTCD1 | 0 |
| RUNDC2B | 0 |
| RXRA | 0 |
| S100Z | 0 |
| S1PR2 | 0 |
| SAA1 | 0 |
| SACS | 0 |
| SAE1 | 0 |
| SAMSN1 | 0 |
| SAP30 | 0 |
| SCARA5 | 0 |
| SDC1 | 0 |
| SDCCAG8 | 0 |
| KIAA0746 | 0 |
| SEMA7A | 0 |
| SEPHS1 | 0 |
| SERBP1 | 0 |
| SERPINA9 | 0 |
| SERPINB1 | 0 |
| SFN | 0 |
| SFPQ | 0 |
| SGK1 | 0 |
| SGOL2 | 0 |
| SH2D1A | 0 |
| SH3BP5 | 0 |
| SHARPIN | 0 |
| SIDT1 | 0 |
| SIRPA | 0 |
| SIRPB1 | 0 |
| SLA | 0 |
| SLAMF1 | 0 |
| SLC12A8 | 0 |
| SLC16A9 | 0 |
| SLC1A4 | 0 |
| SLC31A1 | 0 |
| SLC35E2B | 0 |
| SLC38A5 | 0 |
| SMAD1 | 0 |
| SMAD7 | 0 |
| SMARCA4 | 0 |
| SNAP23 | 0 |
| SNN | 0 |
| SNX11 | 0 |
| SNX22 | 0 |
| SNX29 | 0 |
| SOCS1 | 0 |
| SOCS2 | 0 |
| SOCS3 | 0 |
| SORBS1 | 0 |
| SOX11 | 0 |
| SOX5 | 0 |
| SPAG5 | 0 |
| SPARC | 0 |
| SPARCL1 | 0 |
| SPIB | 0 |
| SPINK2 | 0 |
| SPINT2 | 0 |
| SPON1 | 0 |
| SPRED2 | 0 |
| SPRY1 | 0 |
| SRPK1 | 0 |
| SRPX | 0 |
| SRSF1 | 0 |
| SSBP2 | 0 |
| STAG3 | 0 |
| STAMBPL1 | 0 |
| STAP1 | 0 |
| STAT1 | 0 |
| STAT3 | 0 |
| STEAP1 | 0 |
| STK17A | 0 |
| STK38L | 0 |
| STMN1 | 0 |
| STS | 0 |
| STX11 | 0 |
| SULF1 | 0 |
| SYK | 0 |
| SYPL1 | 0 |
| SYT17 | 0 |
| SYTL4 | 0 |
| TARS | 0 |
| TAX1BP1 | 0 |
| TBC1D27 | 0 |
| TBC1D9 | 0 |
| TCF3 | 0 |
| TCF4 | 0 |
| TCTN3 | 0 |
| TEAD1 | 0 |
| TEK | 0 |
| TERT | 0 |
| TEX9 | 0 |
| TFDP2 | 0 |
| TFPI2 | 0 |
| TGFBR1 | 0 |
| THBS2 | 0 |
| THY1 | 0 |
| TIAM2 | 0 |
| TICAM2 | 0 |
| TJP2 | 0 |
| TK1 | 0 |
| TLE4 | 0 |
| TLK1 | 0 |
| TLR7 | 0 |
| TM4SF1 | 0 |
| TMBIM6 | 0 |
| TMEM109 | 0 |
| TMEM119 | 0 |
| TMOD1 | 0 |
| TMPRSS6 | 0 |
| TNF | 0 |
| TNFAIP2 | 0 |
| TNFAIP3 | 0 |
| TNFRSF13B | 0 |
| TNFRSF14 | 0 |
| TNFRSF17 | 0 |
| TNFRSF19 | 0 |
| TNFSF10 | 0 |
| TNFSF4 | 0 |
| TNIP2 | 0 |
| TNXB | 0 |
| TOP2A | 0 |
| TOX | 0 |
| TP53 | 0 |
| TP73 | 0 |
| TPM1 | 0 |
| TPX2 | 0 |
| TRAF1 | 0 |
| TRAF3 | 0 |
| TRIM25 | 0 |
| TRIM6-TRIM34 | 0 |
| TRIP13 | 0 |
| TTC9 | 0 |
| TUBG1 | 0 |
| TXN | 0 |
| TXNDC5 | 0 |
| TYK2 | 0 |

| Gene | Normalization weights |
|---|---|
| TYMS | 0 |
| UBE2I | 0 |
| UBE2S | 0 |
| USP12 | 0 |
| USP18 | 0 |
| USP46 | 0 |
| VASH2 | 0 |
| VGLL4 | 0 |
| TMEM49 | 0 |
| VWF | 0 |
| WASF1 | 0 |
| WDR25 | 0 |
| WHSC1 | 0 |
| WNT3 | 0 |
| XAF1 | 0 |
| XBP1 | 0 |
| YPEL1 | 0 |
| ZAP70 | 0 |
| ZBTB32 | 0 |
| ZBTB38 | 0 |
| ZBTB8 | 0 |
| ZCCHC7 | 0 |
| ZFP36L1 | 0 |
| ZMYND8 | 0 |
| ZNF238 | 0 |
| ZNF281 | 0 |
| ZNF318 | 0 |
| ZNF385B | 0 |
| ZNF608 | 0 |
| ZNRF1 | 0 |
| ZPBP2 | 0 |
| ZWINT | 0 |
| A2LD1 | 0 |
| ABCA12 | 0 |
| ACSL5 | 0.021276596 |
| AHCYL2 | 0.021276596 |
| AKAP9 | 0.021276596 |
| ASCL2 | 0 |
| ASMTL-AS1 | 0 |
| ATOH8 | 0 |
| ATXN7L2 | 0.021276596 |
| C19orf26 | 0 |
| C4orf31 | 0 |
| CA7 | 0 |
| CAMKK1 | 0 |
| CDK5RAP2 | 0.021276596 |
| CHD4 | 0.021276596 |
| CHST5 | 0 |
| CPA6 | 0 |
| DAZAP2 | 0.021276596 |
| DCLK3 | 0 |
| DNAJB12 | 0.021276596 |
| ERBB2IP | 0.021276596 |
| ERN2 | 0 |
| KIAA0574 | 0 |
| FAR2 | 0 |
| FARP1 | 0 |
| FBXL13 | 0 |
| FBXO36 | 0 |
| FBXO41 | 0.021276596 |
| FCN2 | 0 |
| GAD2 | 0 |
| GATA1 | 0 |
| GATA2 | 0 |
| GIT2 | 0.021276596 |
| GNG4 | 0 |
| GORASP1 | 0.021276596 |
| GSK3B | 0.021276596 |
| GYG2 | 0 |
| H1FOO | 0 |
| HARBI1 | 0.021276596 |
| HHIP | 0 |
| HSP90AA1 | 0.021276596 |
| HSPA12B | 0 |
| HSPA9 | 0.021276596 |
| IK | 0.021276596 |
| ISY1 | 0.021276596 |
| KCNQ3 | 0 |
| KCP | 0 |
| KIF6 | 0 |
| KRAS | 0.021276596 |
| LRP3 | 0 |
| MLL2 | 0.021276596 |
| MLLT10 | 0.021276596 |
| MSX2 | 0 |
| KIAA0774 | 0 |
| NAIF1 | 0.021276596 |
| NEBL | 0 |
| NEU3 | 0.021276596 |
| NHLH2 | 0 |
| NRG1 | 0 |
| OPA1 | 0.021276596 |
| PDE4DIP | 0 |
| RNUXA | 0.021276596 |
| PHF23 | 0.021276596 |
| PMCHL1 | 0 |
| PNLIP | 0 |
| PPP3CC | 0.021276596 |
| PTENP1 | 0 |
| PTPN21 | 0 |
| PTRH1 | 0.021276596 |
| R3HDM1 | 0.021276596 |
| RAB20 | 0.021276596 |
| RANBP9 | 0.021276596 |
| RC3H2 | 0.021276596 |
| RETNLB | 0 |
| RHCE | 0 |
| RNF214 | 0.021276596 |
| RRP1B | 0.021276596 |
| SPATA6 | 0 |
| SPATS1 | 0 |
| SSPN | 0 |
| SUFU | 0.021276596 |
| SPAG4L | 0 |
| SYCP1 | 0 |
| THOC5 | 0.021276596 |
| TRIM56 | 0.021276596 |
| TRIM62 | 0.021276596 |
| TUBB2C | 0.021276596 |
| UBXN4 | 0.021276596 |
| VAC14 | 0.021276596 |
| VRK3 | 0.021276596 |
| WAC | 0.021276596 |
| WDR55 | 0.021276596 |
| WFDC9 | 0 |
| ZBTB37 | 0.021276596 |
| ZCCHC2 | 0.021276596 |
| ZFP42 | 0 |
| ZNF135 | 0 |
| ZNF598 | 0.021276596, |

$r_i$ is the counts for probe set i for gene i on the first reference set of probe sets, and $g_i$ is the counts for probe set i for gene i on the second reference set of probe sets, the mathematical terms with $r_i$ and $g_i$ being equal to zero if no digital gene expression data is obtained from a first and second reference set of probe sets;

(e) classifying the subject as belonging to one of the following groups based on the predictor score of (d): (i) ABC DLBCL, (ii) GCB DLBCL, (iii) PMBL, (iv) BL, or (v) MCL, using the formula:

$$\text{Submodel call} = \begin{cases} -1 & \text{if } \sum_i y_i w_i \leq \text{Lower } cutpoint \\ 0 & \text{Lower } cutpoint < \sum_i y_i w_i < \text{Upper } cutpoint \\ 1 & \sum_i y_i w_i \geq \text{Upper } cutpoint \end{cases}$$

wherein $y_i$ is the predictor score, $w_i$ are the weights associated with the probe set for each gene as listed below:

| Gene | ABC/GCB weights | BL non-Myc weights | BL myc weights | PMBL weights | MCL weights |
|---|---|---|---|---|---|
| ACPP | 0 | 0 | 0 | 0 | 0 |
| ACTG2 | 0 | 0 | 0 | 0 | 0 |
| ADAM12 | 0 | 0 | 0 | −2.166433184 | 0 |
| ADAM28 | 0 | 0 | 0 | 0 | 0 |
| ADH1B | 0 | 0 | 0 | 0 | 0 |
| ADIPOO | 0 | 0 | 0 | 0 | 0 |
| ADO | 0 | 0 | 0 | 0 | 0 |
| AHR | 0 | 0 | −4.866117918 | 0 | 0 |
| AICDA | 0 | 0 | 0 | 0 | 0 |
| AKAP2 | 0 | 0 | 0 | 19.33144328 | 0 |
| AKR1C2 | 0 | 0 | 0 | 0 | 0 |
| ALOX5 | −11.14191131 | 0 | 0 | 0 | 59.14375571 |
| AMIGO2 | 0 | 0 | 0 | 0 | 0 |
| ANKRD13A | −13.1144441 | 0 | 0 | 0 | 0 |
| ANLN | 0 | 0 | 0 | 0 | 0 |
| ANO3 | 0 | 0 | 0 | 0 | 0 |
| ANTXR1 | 0 | 0 | 0 | −2.443912822 | 0 |
| ANUBL1 | 0 | 0 | 0 | 0 | 0 |
| APOL1 | 0 | 0 | 0 | 0 | 0 |
| ARID3A | 16.99118469 | 0 | 0 | 0 | 0 |
| ARID3B | 12.66080868 | 0 | 0 | 0 | 0 |
| ARID5A | 0 | 0 | 0 | 0 | 0 |
| ARL6IP1 | 0 | 0 | 0 | 0 | 0 |
| ARNT2 | 0 | 0 | 0 | 0 | 0 |
| ARNTL | 0 | 0 | 0 | 0 | 0 |
| ASB13 | −19.64578147 | 0 | 0 | 0 | 0 |
| ASPM | 0 | 0 | 0 | 0 | 0 |
| ATF3 | 0 | 0 | 0 | 0 | 0 |
| ATM | 0 | 0 | 0 | 0 | 0 |
| ATP6V0E1 | 0 | 0 | 0 | 0 | 0 |
| AUH | 0 | 0 | 0 | 20.46302485 | 0 |
| AURKA | 0 | 0 | 0 | 0 | 0 |
| AUTS2 | −15.20513307 | 0 | 0 | 0 | 0 |
| BANK1 | 0 | 0 | 0 | −24.53325693 | 0 |
| BASP1 | 0 | 0 | 0 | 0 | 0 |
| BATF | 17.98245577 | 0 | 0 | 0 | 0 |
| BATF3 | 0 | 0 | 0 | 0 | 0 |
| BCAT1 | 0 | 0 | 0 | 0 | −74.11099391 |
| BCL10 | 0 | 0 | 0 | 0 | 0 |
| BCL2 | 0 | 0 | 0 | 0 | 0 |
| BCL2 | 0 | 0 | 0 | 0 | 0 |
| BCL2 | 0 | 0 | 0 | 0 | 0 |
| BCL2 | 0 | 0 | 0 | 0 | 0 |
| BCL2 | 14.07216258 | 0 | 0 | 0 | 0 |
| BCL2 | 0 | 0 | 0 | 0 | 0 |
| BCL2A1 | 0 | 0 | −5.947560928 | 0 | 0 |
| BCL2L10 | 9.91380548 | 0 | 0 | 0 | 0 |
| BCL6 | −17.29479012 | 0 | −5.383296889 | 0 | 0 |
| BEST3 | 0 | 0 | 0 | 0 | 0 |
| BIRC2 | 0 | 0 | 0 | 0 | 0 |
| BIRC3 | 0 | 0 | −5.663158028 | 0 | 0 |
| BRC5 | 0 | 0 | 0 | 0 | 0 |
| BMP7 | 0 | 0 | 0 | 0 | 0 |
| BPGM | 0 | 0 | 0 | 0 | 0 |
| BPNT1 | −11.94204992 | 0 | 0 | 0 | 0 |
| BSPRY | 12.55890968 | 0 | 0 | 0 | 0 |
| BST2 | 0 | 0 | 0 | 0 | 0 |
| BTBD19 | 0 | 0 | 0 | 0 | 0 |
| BTG1 | 0 | 0 | 0 | 0 | 0 |
| BTG2 | 0 | 0 | 0 | 0 | 0 |
| BTK | 0 | 0 | 0 | 0 | 0 |
| BUB1 | 0 | 0 | 0 | 0 | 0 |

-continued

| Gene | ABC/GCB weights | BL non-Myc weights | BL myc weights | PMBL weights | MCL weights |
|---|---|---|---|---|---|
| BUB1B | 0 | 0.129449175 | −6.543666003 | 0 | 0 |
| C10orf18 | −11.23438924 | 0 | 0 | 0 | 0 |
| C13orf18 | 14.60869443 | 0 | 6.676459404 | 0 | 0 |
| C15orf41 | 0 | 0 | 0 | 0 | 0 |
| C3orf37 | −13.2892376 | 0 | 0 | 0 | 0 |
| C5AR1 | 0 | 0 | 0 | 0 | 0 |
| C5orf41 | 0 | 0 | 0 | 0 | 0 |
| C7orf68 | 0 | 0 | 0 | 0 | 0 |
| CACNA1D | 0 | 0 | 0 | 0 | 0 |
| CALD1 | 0 | 0 | 0 | −2.249574505 | 0 |
| CAMK2B | 0 | 0 | 0 | 0 | 0 |
| CARD11 | 13.81862222 | 0 | 0 | −18.72040556 | 0 |
| CAV1 | 0 | 0 | 0 | 0 | 0 |
| CAV2 | 0 | 0 | 0 | 0 | 0 |
| CCDC50 | 18.68358953 | 0 | 5.320661402 | 0 | 68.6051667 |
| CCDC75 | 0 | 0 | 0 | 0 | 0 |
| CCL17 | 0 | 0 | 0 | 25.50999568 | 0 |
| CCNA2 | 0 | 0 | 0 | 0 | 0 |
| CCNB1 | 0 | 0 | 0 | 0 | 0 |
| CCNB2 | 0 | 0 | 0 | 0 | 0 |
| CCND1 | 0 | 0 | 0 | 0 | 0 |
| CCND1 | 0 | 0 | 0 | 0 | 0 |
| CCND1 | 0 | 0 | 0 | 0 | 0 |
| CCND1 | 0 | 0 | 0 | 0 | 0 |
| CCND1 | 0 | 0 | 0 | 0 | 0 |
| CCND1 | 0 | 0 | 0 | 0 | 87.99680321 |
| CCND2 | 13.55862157 | 0 | 0 | 0 | 0 |
| CCND3 | 0 | 0 | 0 | 0 | 0 |
| CCR7 | 11.22811168 | 0 | −4.862612697 | 0 | 0 |
| CD2 | 0 | 0 | 0 | 0 | 0 |
| CD200 | 0 | 0 | 0 | 0 | 0 |
| CD22 | 0 | 0 | 0 | 0 | 0 |
| CD247 | 0 | 0 | 0 | 0 | 0 |
| CD274 | 0 | 0 | 0 | 0 | 0 |
| CD3D | 0 | 0 | 0 | 0 | 0 |
| CD3E | 0 | 0 | 0 | 0 | 0 |
| CD3G | 0 | 0 | 0 | 0 | 0 |
| CD40 | 0 | 0 | 0 | 0 | 0 |
| CD44 | 13.50378135 | 0 | −5.782231847 | 0 | 0 |
| CD47 | 0 | 0 | 0 | 0 | 0 |
| CD5 | 0 | 0 | 0 | 0 | 0 |
| CD58 | 0 | 0 | 0 | 0 | 0 |
| CD6 | 0 | 0 | 0 | 0 | 0 |
| CD74 | 0 | 0 | 0 | 0 | 0 |
| CD79A | 0 | 0 | 0 | 0 | 0 |
| CD79B | 0 | 0 | 0 | 0 | 0 |
| CD8A | 0 | 0 | 0 | 0 | 0 |
| CD8B | 0 | 0 | 0 | 0 | 0 |
| CDC20 | 0 | 0 | 0 | 0 | 0 |
| CDC25B | 0 | 0 | 0 | 0 | 0 |
| CDC25C | 0 | 0 | 0 | 0 | 0 |
| CDCA3 | 0 | 0 | 0 | 0 | 0 |
| CDCA5 | 0 | 0 | 0 | 0 | 0 |
| CDCA8 | 0 | 0 | 0 | 0 | 0 |
| CDH11 | 0 | 0 | 0 | −2.338738276 | 0 |
| CDC2 | 0 | 0 | 0 | 0 | 0 |
| PFTK1 | −15.92270263 | 0 | 0 | 0 | 0 |
| CDK4 | 0 | 0 | 0 | 0 | 0 |
| CDK6 | 0 | 0 | 0 | 0 | −65.86959926 |
| CDKN2A | 0 | 0 | 0 | 0 | 0 |
| CDKN2A | 0 | 0 | 0 | 0 | 0 |
| CDKN3 | 0 | 0 | 0 | 0 | 0 |
| CELSR1 | 0 | 0 | 0 | 0 | 0 |
| CENPA | 0 | 0 | 0 | 0 | 0 |
| CENPE | 0 | 0 | 0 | 0 | 0 |
| CENPF | 0 | 0 | 0 | 0 | 0 |
| CENPN | 0 | 0 | 0 | 0 | 0 |
| PRR6 | 0 | 0 | 0 | 22.43680643 | 0 |
| CEP55 | 0 | 0 | 0 | 0 | 0 |
| CFLAR | 16.61287119 | 0 | −5.100315997 | 0 | 0 |
| CGNL1 | 0 | 0 | 0 | −2.156504887 | 0 |
| CIITA | 0 | 0 | 0 | 0 | 0 |
| CKS2 | 0 | 0 | 0 | 0 | 0 |
| CLIP2 | 0 | 0 | 0 | 20.2768953 | 0 |
| CLMN | 0 | 0 | 0 | 0 | 0 |
| CPNE3 | −11.49752906 | 0 | 0 | 0 | 0 |

-continued

| Gene | ABC/GCB weights | BL non-Myc weights | BL myc weights | PMBL weights | MCL weights |
|---|---|---|---|---|---|
| CR2 | −12.2225611 | 0 | −5.465732584 | −19.63179827 | 0 |
| CREB3L2 | 19.29029329 | 0 | 0 | 0 | 0 |
| CREBBP | 0 | 0 | 0 | 0 | 0 |
| CSF2RA | 0 | 0 | 0 | −2.424880636 | 0 |
| CSTA | 0 | 0 | 0 | −2.543864326 | 0 |
| CTGF | 0 | 0 | 0 | 0 | 0 |
| CTH | 0 | 0 | 0 | 0 | 0 |
| CTHRC1 | 0 | 0 | 0 | −2.518684898 | 0 |
| CTLA4 | 0 | 0 | 0 | 0 | 0 |
| CTNNA2 | 0 | 0 | 0 | 0 | 0 |
| CTPS | 0 | 0 | 0 | 0 | 0 |
| CTSH | 0 | 0 | −5.145507824 | 0 | 0 |
| CTSK | 0 | 0 | 0 | −2.572873829 | 0 |
| CXCL10 | 0 | 0 | 0 | 0 | 0 |
| CXCL12 | 0 | 0 | 0 | 0 | 0 |
| CXCL9 | 0 | 0 | 0 | 0 | 0 |
| CYB5R2 | 19.12600362 | 0 | 0 | 0 | 0 |
| CYP27A1 | 0 | 0 | 0 | −2.635085165 | 0 |
| CYP2J2 | 0 | 0 | 0 | 0 | 0 |
| CYSLTR1 | 0 | 0 | 0 | 0 | 0 |
| DCBLD1 | 0 | 0 | 0 | 0 | 0 |
| DCTD | 15.98936135 | 0 | 0 | 0 | 0 |
| DDAH2 | 0 | 0 | 0 | 0 | 0 |
| DDX58 | 0 | 0 | 0 | 0 | 0 |
| DENND4A | 0 | 0 | 0 | 21.20254474 | 0 |
| DLC1 | 0 | 0 | 0 | 0 | 0 |
| DLEU1 | 0 | 0 | 0 | 0 | 0 |
| DLGAP5 | 0 | 0 | 0 | 0 | 0 |
| DNAJA1 | 0 | 0 | 0 | 0 | 0 |
| DNAJB9 | 0 | 0 | 0 | 0 | 0 |
| DNAJC10 | −12.209423 | 0 | 0 | 0 | 0 |
| DNMT3A | 0 | 0 | 0 | 0 | 0 |
| DOCK10 | 15.87228876 | 0 | 0 | 17.13938941 | 0 |
| DPY19L1 | 0 | 0 | 0 | 0 | 0 |
| DPYSL3 | 0 | 0 | 0 | −2.427210322 | 0 |
| DRAM | 0 | 0 | 0 | 0 | 0 |
| DTX1 | 0 | 0 | 0 | 0 | 0 |
| E2F2 | 0 | 0 | 4.871853059 | 0 | 0 |
| E2F8 | 0 | 0 | 0 | 0 | 0 |
| EBV_BZLF1 | 0 | 0 | 0 | 0 | 0 |
| EBV_EBER1 | 0 | 0 | 0 | 0 | 0 |
| EBV_EBER2 | 0 | 0 | 0 | 0 | 0 |
| EBV_EBNA1_CDS | 0 | 0 | 0 | 0 | 0 |
| EBV_EBNA2_3'_end | 0 | 0 | 0 | 0 | 0 |
| EBV_EBNA2_long | 0 | 0 | 0 | 0 | 0 |
| EBV_EBNA3A | 0 | 0 | 0 | 0 | 0 |
| EBV_EBNA3B | 0 | 0 | 0 | 0 | 0 |
| EBV_EBNA3C | 0 | 0 | 0 | 0 | 0 |
| EBV_LMP1_3'_end | 0 | 0 | 0 | 0 | 0 |
| EBV_LMP1_unique | 0 | 0 | 0 | 0 | 0 |
| EBV_LPM2A | 0 | 0 | 0 | 0 | 0 |
| EEPD1 | −14.43898719 | 0 | 0 | 0 | 0 |
| EFEMP2 | 0 | 0 | 0 | −2.309390981 | 0 |
| EGFL7 | 0 | 0 | 0 | 0 | 0 |
| EHD2 | 0 | 0 | 0 | 0 | 0 |
| EIF5AL1 | 0 | 0 | 0 | 0 | 0 |
| ELL2 | 12.74051826 | 0 | −5.784944094 | 0 | 0 |
| EML1 | 0 | 0 | 0 | −2.370584039 | 0 |
| EMR1 | 0 | 0 | 0 | 0 | 0 |
| ENO1 | 0 | 0 | 0 | 0 | 0 |
| ENPP3 | 0 | 0 | 0 | 0 | 0 |
| ENTPD1 | 12.50562718 | 0 | 0 | 0 | 0 |
| EP300 | 0 | 0 | 0 | 0 | 0 |
| EPHB1 | 0 | 0 | 0 | 0 | 0 |
| EPSTII | 0 | 0 | 0 | 0 | 0 |
| ERG | 0 | 0 | 0 | 0 | 0 |
| ERP29 | 14.40630514 | 0 | 0 | 0 | 0 |
| TXNDC4 | 0 | 0 | 0 | 0 | 0 |
| ESPL1 | 0 | 0 | 0 | 0 | 0 |
| ETV6 | 17.10124803 | 0 | 0 | 0 | 0 |
| EXO1 | 0 | 0 | 0 | 0 | 0 |
| FABP4 | 0 | 0 | 0 | 0 | 0 |
| FAM108C1 | 13.9119712 | 0 | 0 | 0 | 0 |
| FAM159A | 0 | 0 | 0 | −19.09112771 | 0 |
| FAM171B | 0 | 0 | 0 | 20.15840479 | 0 |
| FAM46C | 16.04589049 | 0 | 0 | 0 | 0 |

| Gene | ABC/GCB weights | BL non-Myc weights | BL myc weights | PMBL weights | MCL weights |
|---|---|---|---|---|---|
| FAM69A | 0 | 0 | 0 | 20.26920874 | 0 |
| FAM83D | 0 | 0 | 0 | 0 | 0 |
| FAP | 0 | 0 | 0 | −2.448537997 | 0 |
| FAS | 0 | 0 | 0 | 19.4917463 | 0 |
| FBP2 | 0 | 0 | 0 | 0 | 0 |
| FBXO10 | 0 | 0 | 0 | 0 | 0 |
| FBXO11 | 0 | 0 | 0 | 0 | 0 |
| FCER2 | 0 | 0 | 0 | 19.36530173 | 0 |
| FEZ1 | 0 | 0 | 0 | 0 | 0 |
| FGL2 | 0 | 0 | 0 | 0 | 0 |
| FKBP11 | 10.77110305 | 0 | 0 | 0 | 0 |
| FKBP2 | 0 | 0 | 0 | 0 | 0 |
| FLJ42418 | −13.07282539 | 0 | 0 | 0 | 0 |
| FLNA | 0 | 0 | 0 | 0 | 0 |
| FN1 | 0 | 0 | 0 | −2.515692387 | 0 |
| FNBP1 | 0 | 0 | 0 | 0 | 0 |
| FNDC1 | −9.924277783 | 0 | 0 | −2.337279029 | 0 |
| FOXM1 | 0 | 0 | 0 | 0 | 0 |
| FOXO1 | 0 | 0 | 0 | 0 | 0 |
| FOXP1 | 0 | 0 | 0 | 0 | 0 |
| FSCN1 | 0 | 0 | 0 | 0 | 0 |
| FUT8 | 12.89311878 | 0 | 0 | 0 | 0 |
| FYB | 0 | 0 | 0 | 0 | 0 |
| GBP1 | 0 | 0 | 0 | 0 | 0 |
| GBP4 | 0 | 0 | 0 | 0 | 0 |
| GCET2 | 0 | 0 | 0 | 17.14715594 | 0 |
| GGT1 | 0 | 0 | 0 | 0 | 0 |
| GHR | 0 | 0 | 0 | 0 | 0 |
| GLDC | 0 | 0 | 0 | 0 | 0 |
| GLRX | 0 | 0 | 0 | 0 | 0 |
| GNA13 | −13.98237394 | 0 | 0 | 0 | 0 |
| GNB4 | 0 | 0 | 0 | 0 | 0 |
| GNG10 | 0 | 0 | 0 | 0 | 0 |
| GNL3 | 13.0455436 | 0.131002027 | −6.622162805 | 0 | 0 |
| GPR116 | 0 | 0 | 0 | 0 | 0 |
| GPR176 | 0 | 0 | 0 | 0 | 0 |
| GPR183 | 0 | 0 | 0 | 0 | 0 |
| GRAMD1B | 0 | 0 | 0 | 0 | 0 |
| GRB10 | 0 | 0 | 0 | 0 | 0 |
| GRSF1 | 0 | 0 | 0 | 0 | 0 |
| GTSE1 | 0 | 0 | 0 | 0 | 0 |
| GLT8D4 | 0 | 0 | 0 | 0 | 0 |
| GYPC | 0 | 0 | 0 | 17.83003931 | 0 |
| H2AFV | 0 | 0 | 0 | 0 | 0 |
| H2AFX | 0 | 0 | 0 | 0 | 0 |
| HCK | 15.54344514 | 0 | −5.412764958 | 0 | 0 |
| HDAC1 | −15.02975702 | 0 | 0 | 0 | 0 |
| HDAC2 | 0 | 0 | 0 | 0 | 0 |
| HDGF | 0 | 0.116000721 | −5.863845581 | 0 | 0 |
| HEG1 | 0 | 0 | 0 | −2.46106726 | 0 |
| HHV8_BCL2_homologue | 0 | 0 | 0 | 0 | 0 |
| HHV8_K1-32_Bcb_K1_protein | 0 | 0 | 0 | 0 | 0 |
| HHV8_ORF73-LANA | 0 | 0 | 0 | 0 | 0 |
| HHV8_T0.7/P6 | 0 | 0 | 0 | 0 | 0 |
| HHV8_T1.1 | 0 | 0 | 0 | 0 | 0 |
| HHV8_vFLIP_ORF71 | 0 | 0 | 0 | 0 | 0 |
| HHV8_vIL6 | 0 | 0 | 0 | 0 | 0 |
| HHV8_vMIP1b_ORFK4.2_KIE-3 | 0 | 0 | 0 | 0 | 0 |
| HJURP | 0 | 0 | 0 | 0 | 0 |
| HLA-A | 0 | 0 | 0 | 0 | 0 |
| HLA-B | 0 | 0 | 0 | 0 | 0 |
| HLA-C | 0 | 0 | 0 | 0 | 0 |
| HLA-DMA | 0 | 0 | −4.825417012 | 0 | 0 |
| HLA-DPA1 | 0 | 0 | 0 | 0 | 0 |
| HLA-DPB1 | 0 | 0 | 0 | 0 | 0 |
| HLA-DQA1 | 0 | 0 | 0 | 0 | 0 |
| HLA-DRA | 0 | 0 | 0 | 0 | 0 |
| HLA-E | 0 | 0 | 0 | 0 | 0 |
| HLA-F | 0 | 0 | 0 | 0 | 0 |
| HOMER2 | 0 | 0 | 0 | 19.38721241 | 0 |
| HOPX | −14.01730842 | 0 | 0 | 0 | 0 |
| HPCAL1 | 0 | 0 | 0 | 0 | 59.25326244 |
| HSP90B1 | 15.53130763 | 0 | 0 | 0 | 0 |

-continued

| Gene | ABC/GCB weights | BL non-Myc weights | BL myc weights | PMBL weights | MCL weights |
|---|---|---|---|---|---|
| HSPB8 | 0 | 0 | 0 | −2.192325405 | 0 |
| HTRA1 | 0 | 0 | 0 | −2.354416381 | 0 |
| HYOU1 | 0 | 0 | 0 | 0 | 0 |
| ICAM1 | 0 | 0 | −5.307124944 | 0 | 0 |
| ID1 | 0 | 0 | 0 | 0 | 0 |
| ID2 | 0 | 0 | 0 | 0 | 0 |
| ID3 | 0 | 0 | 0 | 0 | 0 |
| IDS | 0 | 0 | 0 | 0 | 0 |
| IER3 | 0 | 0 | 0 | 0 | 0 |
| IFI16 | 0 | 0 | 0 | 0 | 0 |
| IFI35 | 0 | 0 | 0 | 0 | 0 |
| IFI44L | 0 | 0 | 0 | 0 | 0 |
| IFI6 | 0 | 0 | 0 | 0 | 0 |
| IFIH1 | 0 | 0 | 0 | 21.31413442 | 0 |
| IFIT1 | 0 | 0 | 0 | 0 | 0 |
| IFIT2 | 0 | 0 | 0 | 0 | 0 |
| IFIT3 | 0 | 0 | 0 | 0 | 0 |
| IFITM1 | 0 | 0 | 0 | 0 | 0 |
| IFNAR1 | 0 | 0 | 0 | 0 | 0 |
| IFNAR2 | 0 | 0 | 0 | 0 | 0 |
| IFNB1 | 0 | 0 | 0 | 0 | 0 |
| IgA2_constant_region | 0 | 0 | 0 | 0 | 0 |
| IgE_constant_region | 0 | 0 | 0 | 0 | 0 |
| IGSF3 | 0 | 0 | 0 | 0 | 0 |
| IgG2_constant_region | 0 | 0 | 0 | 0 | 0 |
| IgG4_constant_region | 0 | 0 | 0 | 0 | 0 |
| IGSF3 | 11.04304441 | 0 | 0 | 18.36718646 | 0 |
| IL10 | 0 | 0 | 0 | 0 | 0 |
| IL12A | 10.87451224 | 0 | 0 | 0 | 0 |
| IL13 | 0 | 0 | 0 | 0 | 0 |
| IL13RA1 | 0 | 0 | 0 | 22.21511102 | 0 |
| IL16 | 15.38015948 | 0 | 0 | 0 | 0 |
| IL17RB | 10.16999574 | 0 | 0 | 0 | 0 |
| IL4I1 | 0 | 0 | 0 | 0 | 0 |
| IL6 | 0 | 0 | 0 | 0 | 0 |
| ING1 | 0 | 0 | 0 | 0 | 0 |
| INPP5D | 0 | 0 | 0 | 0 | 0 |
| IRAK1 | 0 | 0 | 0 | 0 | 0 |
| IRAK2 | 0 | 0 | 0 | 0 | 0 |
| IRAK3 | 0 | 0 | 0 | 0 | 0 |
| IRAK4 | 0 | 0 | 0 | 0 | 0 |
| IRF1 | 0 | 0 | 0 | 0 | 0 |
| IRF3 | 0 | 0 | 0 | 0 | 0 |
| IRF4 | 21.21696785 | 0 | 0 | 0 | 0 |
| IRF5 | 0 | 0 | 0 | 0 | 0 |
| IRF7 | 0 | 0 | 0 | 0 | 0 |
| ISG15 | 0 | 0 | 0 | 18.22975543 | 0 |
| ITGA9 | 0 | 0 | 0 | 0 | 0 |
| ITGAV | 0 | 0 | 0 | −2.502427838 | 0 |
| ITGAX | 0 | 0 | 0 | −2.527107115 | 0 |
| ITGB2 | 0 | 0 | −5.354319759 | 0 | 0 |
| ITPKB | −19.39129721 | 0 | 0 | 0 | 0 |
| JAK1 | 0 | 0 | 0 | 0 | 0 |
| JAK2 | 0 | 0 | 0 | 18.78741327 | 0 |
| JAK3 | 0 | 0 | −4.911758111 | 12 | 0 |
| KCNJ1 | 0 | 0 | 0 | 0 | 0 |
| KCNK12 | −12.19178395 | 0 | 0 | 0 | 0 |
| KCNMA1 | 0 | 0 | 0 | 0 | 0 |
| JMJD2C | 0 | 0 | 0 | 0 | 0 |
| KDR | 0 | 0 | 0 | 0 | 0 |
| KIAA1147 | 0 | 0 | 0 | 0 | 0 |
| K1AA1274 | −11.88673995 | 0 | 0 | 0 | 0 |
| KIF11 | 0 | 0 | 0 | 0 | 0 |
| KIF14 | 0 | 0 | 0 | 0 | 0 |
| KIF15 | 0 | 0 | 0 | 0 | 0 |
| KIF18A | 0 | 0 | 0 | 0 | 0 |
| KIF18B | 0 | 0 | 0 | 0 | 0 |
| KIF20A | 0 | 0 | 0 | 0 | 0 |
| KIF23 | 0 | 0 | 0 | 0 | 0 |
| KIF2C | 0 | 0 | 0 | 0 | 0 |
| KIF4A | 0 | 0 | 0 | 0 | 0 |
| KLHL5 | −10.77233553 | 0 | 0 | 0 | 0 |
| KPNA2 | 0 | 0 | 0 | 0 | 0 |
| KYNU | 0 | 0 | 0 | 23.67824397 | 0 |
| LAMB1 | 0 | 0 | 0 | 0 | 0 |
| LAMP3 | 0 | 0 | 0 | 0 | 0 |

| Gene | ABC/GCB weights | BL non-Myc weights | BL myc weights | PMBL weights | MCL weights |
|---|---|---|---|---|---|
| LANCL1 | −11.96529389 | 0 | 0 | 0 | 0 |
| LAT | 0 | 0 | 0 | 0 | 0 |
| LAT2 | 0 | 0 | 0 | 0 | 0 |
| LDHA | 0 | 0 | 0 | 0 | −62.43798035 |
| LHFPL3 | 0 | 0 | 0 | 0 | 0 |
| LHX2 | 0 | 0 | 0 | 0 | 0 |
| LIMA1 | 0 | 0 | 0 | 22.38509346 | 0 |
| LIMD1 | 17.83248768 | 0 | 0 | 0 | 0 |
| LMAN2 | 0 | 0 | 0 | 0 | 0 |
| LMO2 | −16.98695863 | 0 | −9.427107802 | 0 | 0 |
| LOC643529 | 0 | 0 | 0 | 0 | 0 |
| LOXL2 | 0 | 0 | 0 | 0 | 0 |
| LPCAT3 | 0 | 0 | 0 | 0 | 0 |
| LRMP | −15.8755653 | 0 | 0 | 0 | 0 |
| LRPPRC | 0 | 0 | 0 | 0 | 0 |
| LRRC15 | −12.69088474 | 0 | 0 | −2.555292482 | 0 |
| LRRC33 | 15.08028382 | 0 | 0 | 0 | 0 |
| LTBP2 | 0 | 0 | 0 | −2.274436223 | 0 |
| LYPD6B | −12.18942045 | 0 | 0 | 0 | 0 |
| LYZ | 0 | 0 | 0 | −2.548310761 | 0 |
| MACROD2 | 0 | 0 | 0 | 0 | 0 |
| MAL | 0 | 0 | 0 | 21.94306064 | 0 |
| MALT1 | 0 | 0 | 0 | 0 | 0 |
| MAML3 | −17.94799886 | 0 | 0 | 0 | 0 |
| MAP3K1 | 0 | 0 | 0 | 0 | 55.17626389 |
| MAP3K8 | 0 | 0 | 0 | 0 | 0 |
| MAP4K4 | −10.29136026 | 0 | 0 | 0 | 0 |
| MAPK10 | −14.19048558 | 0 | 0 | 0 | 0 |
| MAPKAPK5 | 0 | 0 | 0 | 0 | 0 |
| MARCKS | 0 | 0 | 0 | 0 | 0 |
| MARCKSL1 | −16.15992041 | 0 | −5.183663919 | 0 | 0 |
| MAST2 | −13.37445723 | 0 | 0 | 0 | 0 |
| MATR3 | 0 | 0 | 0 | 0 | 0 |
| MCL1 | 0 | 0 | 0 | 0 | 0 |
| MCM10 | 0 | 0 | 0 | 0 | 0 |
| MCM7 | 0 | 0 | 0 | 0 | 0 |
| MDFIC | 0 | 0 | −6.830814658 | 0 | 0 |
| MDM2 | 0 | 0 | 0 | 0 | 0 |
| MFAP5 | 0 | 0 | 0 | 0 | 0 |
| MFNG | 0 | 0 | 0 | 0 | 0 |
| MFSD2A | 0 | 0 | 0 | 0 | 0 |
| MGC87042 | 0 | 0 | 0 | 0 | 0 |
| MIR17HG | 0 | 0 | 0 | 0 | 0 |
| MKI67 | 0 | 0 | 0 | 0 | 0 |
| MME | −18.26084621 | 0 | 0 | 0 | 0 |
| MMP1 | 0 | 0 | 0 | 0 | 0 |
| MMP2 | 0 | 0 | 0 | −2.575770684 | 0 |
| MMP9 | 0 | 0 | 0 | −2.62062289 | 0 |
| MMRN2 | 0 | 0 | 0 | 0 | 0 |
| MNDA | 0 | 0 | 0 | 0 | 0 |
| MOBKL2C | 0 | 0 | 0 | 24.05195347 | 0 |
| MPEG1 | 13.61757622 | 0 | 0 | 0 | 0 |
| MS4A1 | 0 | 0 | 0 | 0 | 0 |
| MST1R | 0 | 0 | 0 | 0 | 0 |
| MTHFD2 | 0 | 0 | 0 | 0 | −64.88192756 |
| MUC16 | 0 | 0 | 0 | 0 | 0 |
| MYB | 0 | 0 | 6.206314452 | 0 | 0 |
| MYBL1 | −19.42564163 | 0 | 0 | 0 | 0 |
| MYC | 0 | 0.129410593 | −6.541715697 | 0 | 0 |
| MYD88 | 0 | 0 | 0 | 0 | 0 |
| MYO7A | 0 | 0 | 0 | 0 | 0 |
| FAM128B | 0 | 0 | 0 | 0 | 0 |
| NANS | 0 | 0 | −5.411187191 | 0 | −62.00052085 |
| NASP | 0 | 0 | 0 | 0 | 0 |
| NBN | 0 | 0 | 0 | 0 | 0 |
| NCAPG | 0 | 0 | 0 | 0 | 0 |
| NCAPH | 0 | 0 | 0 | 0 | 0 |
| NCF2 | 0 | 0 | 0 | 17.12736383 | 0 |
| NCRNA00158 | 0 | 0 | 0 | 0 | 0 |
| NDST4 | 0 | 0 | 0 | 0 | 0 |
| NECAP2 | 0 | 0 | 0 | 17.90953211 | 0 |
| NEIL1 | −16.14074081 | 0 | 0 | 0 | 0 |
| NEK6 | −14.536944 | 0 | 0 | 0 | 0 |
| NFATC1 | 0 | 0 | 0 | 0 | 0 |
| NFIL3 | 0 | 0 | 0 | 23.55828096 | 0 |
| NFKBIA | 0 | 0 | 0 | 0 | 0 |

-continued

| Gene | ABC/GCB weights | BL non-Myc weights | BL myc weights | PMBL weights | MCL weights |
|---|---|---|---|---|---|
| NFKBIZ | 14.96909754 | 0 | 0 | 0 | 0 |
| NIPA2 | 12.59506241 | 0 | 0 | 0 | 0 |
| NOC3L | 11.52493513 | 0 | 0 | 0 | 0 |
| NOL14 | 0 | 0 | 0 | 0 | 0 |
| NOL5A | 0 | 0.123010002 | −6.218165306 | 0 | 0 |
| NOTCH1 | 0 | 0 | 0 | 0 | 0 |
| NOTCH2 | 0 | 0 | 0 | 0 | 0 |
| NUF2 | 0 | 0 | 0 | 0 | 0 |
| NUP62 | 0 | 0 | 0 | 0 | 0 |
| NUSAP1 | 0 | 0 | 0 | 0 | 0 |
| OAS2 | 0 | 0 | 0 | 0 | 0 |
| OAS3 | 0 | 0 | 0 | 0 | 0 |
| OPN3 | 0 | 0 | 0 | 0 | 0 |
| OSBPL3 | −13.37500509 | 0 | 0 | 0 | 0 |
| PA2G4 | 0 | 0 | 0 | 0 | 0 |
| PAG1 | −16.35818989 | 0 | 0 | 0 | 0 |
| DKEZP564O0823 | 0 | 0 | 0 | 0 | 0 |
| PAX6 | 0 | 0 | 0 | 0 | 0 |
| PCNA | 0 | 0 | 0 | 0 | 0 |
| PDCD1LG2 | 0 | 0 | 0 | 0 | 0 |
| PDE9A | −12.58569832 | 0 | 0 | 0 | 0 |
| PDGFRA | 0 | 0 | 0 | 0 | 0 |
| PDIA4 | 0 | 0 | 0 | 0 | 0 |
| PDIA5 | 11.45635103 | 0 | 0 | 0 | 0 |
| PDK4 | 0 | 0 | 0 | 0 | 0 |
| PDLIM1 | 14.15712166 | 0 | 0 | 0 | 0 |
| PDLIM3 | 0 | 0 | 0 | 0 | 0 |
| PDPN | 0 | 0 | 0 | −2.469335735 | 0 |
| PECAM1 | 0 | 0 | 0 | 0 | 0 |
| PECR | 0 | 0 | 0 | 0 | 0 |
| PGAM1 | 0 | 0 | 0 | 0 | 0 |
| PHC3 | 0 | 0 | 0 | 0 | 0 |
| PHF16 | 15.59828263 | 0 | 0 | 0 | 0 |
| PIK3CA | 0 | 0 | 0 | 0 | 0 |
| PIK3CD | 0 | 0 | 0 | 0 | 0 |
| PIM1 | 13.17752239 | 0 | 0 | 0 | 0 |
| PIM2 | 19.17848124 | 0 | 0 | 0 | 0 |
| PLAU | 0 | 0 | −4.942137646 | −2.638406534 | 0 |
| PLEK | 0 | 0 | −5.140753466 | 0 | 0 |
| PLEKHF2 | −14.32290025 | 0 | 0 | 0 | 0 |
| PLEKHG4B | 0 | 0 | 0 | 0 | 0 |
| PLXNB1 | 0 | 0 | 0 | 0 | 0 |
| PMEPA1 | −11.10781933 | 0 | 0 | −2.5144432 | 0 |
| PMP22 | 0 | 0 | 0 | 0 | 0 |
| NP | 11.18914667 | 0 | 0 | 0 | 0 |
| POU2AF1 | 0 | 0 | 0 | 0 | 0 |
| POU2F1 | 0 | 0 | 0 | 0 | 0 |
| POU2F2 | 0 | 0 | 0 | 0 | 0 |
| PPA1 | 0 | 0 | 0 | 0 | −58.07910524 |
| PPP2R3B | 0 | 0 | 0 | 0 | 0 |
| FAM152B | 0 | 0 | 0 | 0 | 0 |
| PRDM1 | 0 | 0 | 0 | 0 | 0 |
| PRDM12 | 0 | 0 | 0 | 0 | 0 |
| PRDX2 | 0 | 0 | 0 | −23.58686384 | 0 |
| PRDX4 | 0 | 0 | 0 | 0 | 0 |
| PRICKLE1 | 0 | 0 | 0 | 0 | 56.2707098 |
| PRKCB | 0 | 0 | 0 | −16.97009784 | 0 |
| PRMT1 | 0 | 0 | 0 | 0 | 0 |
| PRPSAP2 | −12.13413417 | 0 | 0 | 0 | 0 |
| PRSS1 | 0 | 0 | 0 | 0 | 0 |
| PSMG1 | 0 | 0 | 0 | 0 | 0 |
| PTEN | 0 | 0 | 0 | 0 | 0 |
| PTGER4 | 0 | 0 | 0 | 0 | 0 |
| PTGIR | 0 | 0 | 0 | 26.72740141 | 0 |
| PTK2 | −13.78968685 | 0 | −4.948036735 | 0 | 0 |
| PTPN1 | 13.38225581 | 0 | 0 | 0 | 0 |
| PTPRB | 0 | 0 | 0 | 0 | 0 |
| PVRL1 | 0 | 0 | 0 | 0 | 0 |
| PXDN | 0 | 0 | 0 | 0 | 0 |
| OSOX1 | 0 | 0 | 0 | 0 | 0 |
| RAB31 | 0 | 0 | 0 | 0 | 0 |
| RAB33A | 0 | 0 | −4.912839787 | 0 | 0 |
| RAB3A | 0 | 0 | 0 | 0 | 0 |
| RAB7L1 | 20.66492996 | 0 | 0 | 0 | 0 |
| RAPGEF5 | −14.68045686 | 0 | 0 | 0 | 0 |
| RARRES2 | 0 | 0 | 0 | −2.570678175 | 0 |

-continued

| Gene | ABC/GCB weights | BL non-Myc weights | BL myc weights | PMBL weights | MCL weights |
|---|---|---|---|---|---|
| RASGRP3 | 0 | 0 | −6.000117265 | 0 | 0 |
| RASSF4 | 0 | 0 | 0 | 0 | 0 |
| RBCK1 | 0 | 0 | 0 | 0 | 0 |
| RCL1 | 0 | 0 | 0 | 19.91410729 | 0 |
| REL | −10.88675527 | 0 | 0 | 0 | 0 |
| RFTN1 | −10.08136072 | 0 | 0 | 0 | 0 |
| RGL1 | 0 | 0 | 0 | 0 | 0 |
| RGS9 | 0 | 0 | 0 | 18.38318043 | 0 |
| RHEBL1 | 0 | 0 | 0 | 0 | 0 |
| RHOF | 0 | 0 | 0 | 19.45176982 | 0 |
| RHOXF1 | 0 | 0 | 0 | 0 | 0 |
| RNASEH2B | 0 | 0 | 0 | 0 | 0 |
| RNF31 | 0 | 0 | 0 | 0 | 0 |
| RNGTT | 0 | 0 | 0 | 0 | 0 |
| ROBO1 | 0 | 0 | 0 | −2.163573921 | 0 |
| ROBO4 | 0 | 0 | 0 | 0 | 0 |
| RPN2 | 0 | 0 | 0 | 0 | 0 |
| RPS6KA5 | 0 | 0 | 0 | 0 | 0 |
| RSAD2 | 0 | 0 | 0 | 0 | 0 |
| RTCD1 | 0 | 0 | 0 | 0 | 0 |
| RUNDC2B | 0 | 0 | 0 | 0 | 0 |
| RXRA | 0 | 0 | 0 | 0 | 0 |
| S100Z | −12.22316337 | 0 | 0 | 0 | 0 |
| S1PR2 | −21.44566507 | 0 | 0 | 0 | 0 |
| SAA1 | 0 | 0 | 0 | 0 | 0 |
| SACS | 12.97435391 | 0 | 0 | 0 | 0 |
| SAE1 | 0 | 0 | 0 | 0 | 0 |
| SAMSN1 | 0 | 0 | −5.803971429 | 22.68315196 | 0 |
| SAP30 | 0 | 0 | 0 | 0 | 0 |
| SCARA5 | 0 | 0 | 0 | −2.335496267 | 0 |
| SDC1 | 0 | 0 | 0 | 0 | 0 |
| SDCCAG8 | 0 | 0 | 0 | 0 | 0 |
| KIAA0746 | −15.04224714 | 0 | 0 | 0 | 0 |
| SEMA7A | 0 | 0 | 0 | 0 | 0 |
| SEPHS1 | 0 | 0 | 0 | 0 | 0 |
| SERBP | 0 | 0 | 0 | 0 | 0 |
| SERPINA9 | −17.70615386 | 0 | −4.937282176 | 0 | 0 |
| SERPINB1 | 0 | 0 | 0 | 0 | 0 |
| SFN | 0 | 0 | 0 | 0 | 0 |
| SFPQ1 | 0 | 0 | 0 | 0 | 0 |
| SGK1 | −9.835329752 | | −5.684745402 | 0 | 0 |
| SGOL2 | 0 | 0 | 0 | 0 | 0 |
| SH2D1A | 0 | 0 | 0 | 0 | 0 |
| SH3BP5 | 17.2475192 | 0 | 0 | 0 | 0 |
| SHARPIN | 0 | 0 | 0 | 0 | 0 |
| SIDT1 | 10.70030882 | 0 | 0 | 0 | 0 |
| SIRPA | 0 | 0 | 0 | 0 | 0 |
| SIRPB1 | 0 | 0 | 0 | 0 | 0 |
| SLA | 16.00267223 | 0 | 0 | 0 | 0 |
| SLAMF1 | −13.70193031 | 0 | −5.135970135 | 20.7055292 | 0 |
| SLC12A8 | 0 | 0 | 0 | 0 | 0 |
| SLC16A9 | 0 | 0 | 0 | 0 | 0 |
| SLC1A4 | 0 | 0 | 0 | 0 | 0 |
| SLC31A1 | 0 | 0 | 0 | 0 | 0 |
| SLC35E2B | 0 | 0 | 0 | 0 | 0 |
| SLC38A5 | 16.76798547 | 0 | 0 | 0 | 0 |
| SMAD1 | 0 | 0 | 0 | 0 | 0 |
| SMAD7 | 0 | 0 | 0 | 0 | 0 |
| SMARCA4 | −13.90289239 | 0 | 5.037186022 | 0 | 0 |
| SNAP23 | 0 | 0 | 0 | 0 | 0 |
| SNN | 0 | 0 | 0 | 0 | 67.01976847 |
| SNX11 | 0 | 0 | 0 | 22.05768278 | 0 |
| SNX22 | −13.10658722 | 0 | 0 | 0 | 0 |
| SNX29 | 0 | 0 | 0 | 19.13395502 | 0 |
| SOCS1 | 0 | 0 | 0 | 0 | 0 |
| SOCS2 | 0 | 0 | 0 | 0 | 0 |
| SOCS3 | 0 | 0 | 0 | 0 | 0 |
| SORBS1 | 0 | 0 | 0 | 0 | 0 |
| SOX11 | 0 | 0 | 0 | 0 | 54.39896926 |
| SOX5 | 0 | 0 | 0 | 0 | 0 |
| SPAG5 | 0 | 0 | 0 | 0 | 0 |
| SPARC | 0 | 0 | 0 | −2.470075697 | 0 |
| SPARCL1 | 0 | 0 | 0 | 0 | 0 |
| SPIB | 0 | 0 | 0 | 0 | 0 |
| SPINK2 | −10.030466 | 0 | 0 | 0 | 0 |
| SPINT2 | 0 | 0 | 0 | 19.59153543 | 0 |

-continued

| Gene | ABC/GCB weights | BL non-Myc weights | BL myc weights | PMBL weights | MCL weights |
|---|---|---|---|---|---|
| SPON1 | 0 | 0 | 0 | 0 | 0 |
| SPRED2 | −11.78392433 | 0 | 0 | 0 | 0 |
| SPRY1 | 0 | 0 | 0 | 0 | 0 |
| SRPK1 | 0 | 0 | 0 | 0 | 0 |
| SRPX | 0 | 0 | 0 | 0 | 0 |
| SRSF1 | 0 | 0 | 0 | 0 | 0 |
| SSBP2 | −16.54355885 | 0 | 0 | 0 | 0 |
| STAG3 | 0 | 0 | 0 | 0 | 0 |
| STAMBPL1 | 14.49186031 | 0 | 0 | 0 | 0 |
| STAP1 | −12.71264348 | 0 | 0 | 0 | 0 |
| STAT1 | 0 | 0 | 0 | 0 | 0 |
| STAT3 | 10.99589419 | 0 | −5.30437752 | 0 | 0 |
| STEAP1 | 0 | 0 | 0 | 0 | 0 |
| STK17A | −12.60874641 | 0 | 0 | 0 | 0 |
| STK38L | 0 | 0 | 0 | 0 | 0 |
| STMN1 | 0 | 0 | 0 | 0 | 0 |
| STS | −9.978596163 | 0 | 0 | 0 | 0 |
| STX11 | 0 | 0 | −5.423455974 | 0 | 0 |
| SULF1 | 0 | 0 | 0 | −2.512044172 | 0 |
| SYK | 0 | 0 | 0 | 0 | 0 |
| SYPL1 | 0 | 0 | 0 | 0 | 0 |
| SYT17 | 0 | 0 | 0 | 0 | 0 |
| SYTL4 | 0 | 0 | 0 | 0 | 0 |
| TARS | 13.55653507 | 0 | 0 | 0 | 0 |
| TAXIBP1 | 0 | 0 | 0 | 0 | 0 |
| TBC1D27 | 0 | 0 | 0 | 0 | 0 |
| TBC1D9 | 0 | 0 | 0 | 0 | 61.55561013 |
| TCF3 | 0 | 0 | 5.046896623 | 0 | 0 |
| TCF4 | 15.61877166 | 0 | 0 | 0 | 0 |
| TCTN3 | 13.00379932 | 0 | 0 | 0 | 0 |
| TEAD1 | 0 | 0 | 0 | 0 | 0 |
| TEK | 0 | 0 | 0 | 0 | 0 |
| TERT | 0 | 0.125565268 | −6.347334222 | 0 | 0 |
| TEX9 | −12.41661821 | 0 | 0 | 0 | 0 |
| TFDP2 | 0 | 0 | 0 | 0 | 0 |
| TFPI2 | 0 | 0 | 0 | 0 | 0 |
| TGFBR1 | 0 | 0 | 0 | 0 | 0 |
| THBS2 | 0 | 0 | 0 | −2.458163143 | 0 |
| THY1 | 0 | 0 | 0 | −2.435821946 | 0 |
| TIAM2 | −10.50158544 | 0 | 0 | 0 | 0 |
| TICAM2 | 10.36653445 | 0 | −4.996251154 | 0 | 0 |
| TJP2 | 0 | 0 | 0 | 0 | 0 |
| TK1 | 0 | 0 | 0 | 0 | 0 |
| TLE4 | 0 | 0 | 0 | 17.47264051 | 0 |
| TLK1 | 12.28505922 | 0 | 0 | 0 | 0 |
| TLR7 | 0 | 0 | 0 | 19.4679966 | 0 |
| TM4SF1 | 0 | 0 | 0 | 0 | 0 |
| TMBIM6 | 0 | 0 | 0 | 0 | 0 |
| TMEM109 | 0 | 0 | 0 | 0 | 0 |
| TMEM119 | −10.5658305 | 0 | −5.379086543 | −2.658347176 | 0 |
| TMOD1 | 0 | 0 | 0 | 19.102924 | 0 |
| TMPRSS6 | 0 | 0 | 0 | 0 | 0 |
| TNF | 0 | 0 | 0 | 0 | 0 |
| TNFAIP2 | 0 | 0 | 0 | 0 | 0 |
| TNFAIP3 | 0 | 0 | 0 | 0 | 0 |
| TNFRSF13B | 19.52210849 | 0 | 0 | 0 | 0 |
| TNFRSF14 | 0 | 0 | 0 | 0 | 0 |
| TNFRSF17 | 0 | 0 | 0 | 20.07405253 | 0 |
| TNFRSF19 | 0 | 0 | 0 | 0 | 0 |
| TNFSF10 | 0 | 0 | 0 | 0 | 0 |
| TNFSF4 | 0 | 0 | 0 | 27.41538607 | 0 |
| TNIP2 | 0 | 0 | 0 | 0 | 0 |
| TNXB | 0 | 0 | 0 | 0 | 0 |
| TOP2A | 0 | 0 | 0 | 0 | 0 |
| TOX | −11.9192864 | 0 | 0 | 0 | 0 |
| TP53 | 0 | 0 | 0 | 0 | 0 |
| TP73 | 0 | 0 | 0 | 0 | 0 |
| TPM1 | 0 | 0 | 0 | −2.197810042 | 0 |
| TPX2 | 0 | 0 | 0 | 0 | 0 |
| TRAF1 | 0 | 0 | 0 | 21.57006782 | 0 |
| TRAF3 | 0 | 0 | 0 | 0 | 0 |
| TRIM25 | 0 | 0 | 0 | 0 | 0 |
| TRIM6-TRIM34 | 0 | 0 | 0 | 0 | 0 |
| TRIP13 | 0 | 0.122871716 | −6.211174921 | 0 | 0 |
| TTC9 | −12.56263701 | 0 | 0 | 0 | 0 |
| TUBG1 | 0 | 0 | 0 | 0 | 0 |

| Gene | ABC/GCB weights | BL non-Myc weights | BL myc weights | PMBL weights | MCL weights |
|---|---|---|---|---|---|
| TXN | 0 | 0 | 0 | 0 | 0 |
| TXNDC5 | 0 | 0 | 0 | 0 | 0 |
| TYK2 | 0 | 0 | 0 | 0 | 0 |
| TYMS | 0 | 0 | 0 | 0 | 0 |
| UBE2I | 0 | 0 | 0 | 0 | 0 |
| UBE2S | 0 | 0 | 0 | 0 | 0 |
| USP12 | −11.66057366 | 0 | 0 | 0 | 0 |
| USP18 | 0 | 0 | 0 | 0 | 0 |
| USP46 | 13.42760916 | 0 | 0 | 0 | 0 |
| VASH2 | 0 | 0 | 0 | 20.35631229 | 0 |
| VGLL4 | 12.24069542 | 0 | 0 | 0 | 0 |
| TMEM49 | 0 | 0 | 0 | 0 | 0 |
| VWF | 0 | 0 | 0 | 0 | 0 |
| WASF1 | 0 | 0 | 0 | 0 | 0 |
| WDR25 | 0 | 0 | 0 | 0 | 0 |
| WHSC1 | 0 | 0 | 0 | 0 | 0 |
| WNT3 | 0 | 0 | 0 | 0 | 55.5970345 |
| XAF1 | 0 | 0 | 0 | 0 | 0 |
| XBP1 | 10.72031521 | 0 | 0 | 0 | 0 |
| YPEL1 | 0 | 0 | 0 | 0 | 0 |
| ZAP70 | 0 | 0 | 0 | 0 | 0 |
| ZBTB32 | 12.89819312 | 0 | 0 | 0 | 0 |
| ZBTB38 | 0 | 0 | 0 | 0 | 0 |
| ZBTB8 | 0 | 0 | 0 | 22.31265521 | 0 |
| ZCCHC7 | −10.53054134 | 0 | 0 | 0 | 0 |
| ZFP36L1 | 0 | 0 | 0 | 0 | 0 |
| ZMYND8 | 0 | 0 | 0 | 0 | 0 |
| ZNF238 | 0 | 0 | 0 | 0 | 0 |
| ZNF281 | 0 | 0 | 0 | 17.18038245 | 0 |
| ZNF318 | −14.69750421 | 0 | 0 | 0 | 0 |
| ZNF385B | 0 | 0 | 0 | 0 | 0 |
| ZNF608 | −12.02764268 | 0 | 0 | 0 | 0 |
| ZNRF1 | 0 | 0 | 0 | 0 | 0 |
| ZPBP2 | 0 | 0 | 0 | 0 | 0 |
| ZWINT | 0 | 0 | 0 | 0 | 0 |
| A2LD1 | 0 | 0 | 0 | 0 | 0 |
| ABCA12 | 0 | 0 | 0 | 0 | 0 |
| ACSL5 | 0 | 0 | 0 | 0 | 0 |
| AHCYL2 | 0 | 0 | 0 | 0 | 0 |
| AKAP9 | 0 | 0 | 0 | 0 | 0 |
| ASCL2 | 0 | 0 | 0 | 0 | 0 |
| ASMTL-AS1 | 0 | 0 | 0 | 0 | 0 |
| ATOH8 | 0 | 0 | 0 | 0 | 0 |
| ATXN7L2 | 0 | 0 | 0 | 0 | 0 |
| C19orf26 | 0 | 0 | 0 | 0 | 0 |
| C4orf31 | 0 | 0 | 0 | 0 | 0 |
| CA7 | 0 | 0 | 0 | 0 | 0 |
| CAMKK1 | 0 | 0 | 0 | 0 | 0 |
| CDK5RAP2 | 0 | 0 | 0 | 0 | 0 |
| CHD4 | 0 | 0 | 0 | 0 | 0 |
| CHST5 | 0 | 0 | 0 | 0 | 0 |
| CPA6 | −10.24419002 | 0 | 0 | 0 | 0 |
| DAZAP2 | 0 | 0 | 0 | 0 | 0 |
| DCLK3 | 0 | 0 | 0 | 0 | 0 |
| DNAJB12 | 0 | 0 | 0 | 0 | 0 |
| ERBB2IP | 0 | 0 | 0 | 0 | 0 |
| ERN2 | 0 | 0 | 0 | 0 | 0 |
| KIAA0574 | 0 | 0 | 0 | 0 | 0 |
| FAR2 | 0 | 0 | 0 | 0 | 0 |
| FARP1 | 0 | 0 | 0 | 0 | 0 |
| FBXL13 | 0 | 0 | 0 | 0 | 0 |
| FBXO36 | 0 | 0 | 0 | 0 | 0 |
| FBXO41 | 0 | 0 | 0 | 0 | 0 |
| FCN2 | 0 | 0 | 0 | 0 | 0 |
| GAD2 | 0 | 0 | 0 | 0 | 0 |
| GATA1 | 0 | 0 | 0 | 0 | 0 |
| GATA2 | 0 | 0 | 0 | 0 | 0 |
| GIT2 | 0 | 0 | 0 | 0 | 0 |
| GNG4 | 0 | 0 | 0 | 0 | 0 |
| GORASP1 | 0 | 0 | 0 | 0 | 0 |
| GSK3B | 0 | 0 | 0 | 0 | 0 |
| GYG2 | 0 | 0 | 0 | 0 | 0 |
| H1FOO | 0 | 0 | 0 | 0 | 0 |
| HARBI1 | 0 | 0 | 0 | 0 | 0 |
| HHIP | 0 | 0 | 0 | 0 | 0 |
| HSP90AA1 | 0 | 0 | 0 | 0 | 0 |

-continued

| Gene | ABC/GCB weights | BL non-Myc weights | BL myc weights | PMBL weights | MCL weights |
|---|---|---|---|---|---|
| HSPA12B | 0 | 0 | 0 | 0 | 0 |
| HSPA9 | 0 | 0 | 0 | 0 | 0 |
| IK | 0 | 0 | 0 | 0 | 0 |
| ISY1 | 0 | 0 | 0 | 0 | 0 |
| KCNQ3 | 0 | 0 | 0 | 0 | 0 |
| KCP | 0 | 0 | 0 | 0 | 0 |
| KIF6 | 0 | 0 | 0 | 0 | 0 |
| KRAS | 0 | 0 | 0 | 0 | 0 |
| LRP3 | 0 | 0 | 0 | 0 | 0 |
| MLL2 | 0 | 0 | 0 | 0 | 0 |
| MLLT10 | 0 | 0 | 0 | 0 | 0 |
| MSX2 | 0 | 0 | 0 | 0 | 0 |
| KIAA0774 | 0 | 0 | 0 | 0 | 0 |
| NAIF1 | 0 | 0 | 0 | 0 | 0 |
| NEBL | 0 | 0 | 0 | 0 | 0 |
| NEU3 | 0 | 0 | 0 | 0 | 0 |
| NHLH2 | 0 | 0 | 0 | 0 | 0 |
| NRG1 | 0 | 0 | 0 | 0 | 0 |
| OPA1 | 0 | 0 | 0 | 0 | 0 |
| PDE4DIP | 0 | 0 | 0 | 0 | 0 |
| RNUXA | 0 | 0 | 0 | 0 | 0 |
| PHF23 | 0 | 0 | 0 | 0 | 0 |
| PMCHL1 | 0 | 0 | 0 | 0 | 0 |
| PNLIP | 0 | 0 | 0 | 0 | 0 |
| PPP3CC | 0 | 0 | 0 | 0 | 0 |
| PTENP1 | 0 | 0 | 0 | 0 | 0 |
| PTPN21 | 0 | 0 | 0 | 0 | 0 |
| PTRH1 | 0 | 0 | 0 | 0 | 0 |
| R3HDM1 | 0 | 0 | 0 | 0 | 0 |
| RAB20 | 0 | 0 | 0 | 0 | 0 |
| RANBP9 | 0 | 0 | 0 | 0 | 0 |
| RC3H2 | 0 | 0 | 0 | 0 | 0 |
| RETNLB | 0 | 0 | 0 | 0 | 0 |
| RHCE | 0 | 0 | 0 | 0 | 0 |
| RNF214 | 0 | 0 | 0 | 0 | 0 |
| RRP1B | 0 | 0 | 0 | 0 | 0 |
| SPATA6 | 0 | 0 | 0 | 0 | 0 |
| SPATS1 | 0 | 0 | 0 | 0 | 0 |
| SSPN | 0 | 0 | 0 | 0 | 0 |
| SUFU | 0 | 0 | 0 | 0 | 0 |
| SPAG4L | 0 | 0 | 0 | 0 | 0 |
| SYCP1 | 0 | 0 | 0 | 0 | 0 |
| THOC5 | 0 | 0 | 0 | 0 | 0 |
| TRIM56 | 0 | 0 | 0 | 0 | 0 |
| TRIM62 | 0 | 0 | 0 | 0 | 0 |
| TUBB2C | 0 | 0 | 0 | 0 | 0 |
| UBXN4 | 0 | 0 | 0 | 0 | 0 |
| VAC14 | 0 | 0 | 0 | 0 | 0 |
| VRK3 | 0 | 0 | 0 | 0 | 0 |
| WAC | 0 | 0 | 0 | 0 | 0 |
| WDR55 | 0 | 0 | 0 | 0 | 0 |
| WFDC9 | 0 | 0 | 0 | 0 | 0 |
| ZBTB37 | 0 | 0 | 0 | 0 | 0 |
| ZCCHC2 | 0 | 0 | 0 | 0 | 0 |
| ZFP42 | 0 | 0 | 0 | 0 | 0 |
| ZNF135 | 0 | 0 | 0 | 0 | 0 |
| ZNF598 | 0 | 0 | 0 | 0 | 0, | and the upper and lower cutpoints for ABC/GCB, BL non-myc, BL myc, PMBL, and MCL submodels are as listed for each submodel below:

| Submodel | Lower Cut-point | Upper Cut-point |
|---|---|---|
| ABC/GCB | 712.91 | 1238.61 |
| BL Non-Myc | −89.39 | −60.39 |
| BL Myc | 1.11 | 1.11 |
| PMBL | −400.06 | −150.06 |
| MCL | −51.92 | 359.08, | and using the logic:
(1) if the MCL submodel has a value of 1, the sample is called MCL,
  if the MCL submodel has a value of 0, the sample is called unclassifiable but borderline MCL,
  if the MCL submodel has a value of −1, proceed to step 2,
(2) if the BL non-myc submodel has a value of 1, proceed to step 3,
  if the BL non-myc submodel has a value of 0, the sample is called unclassifiable but borderline BL,
  if the BL non-myc submodel has a value of −1, proceed to step 4,
(3) if the BL myc submodel has a value of 0 or 1, the sample is called BL, if the BL myc submodel has a value of −1, the sample is called unclassifiable but borderline BL,
(4) if the PMBL submodel has a value of 1, the sample is called PMBL,
if the PMBL submodel has a value of 0, the sample is called unclassifiable but borderline PMBL,
if the PMBL submodel has a value of −1, proceed to step 5,
(5) if the ABC/GCB submodel has a value of 1, the sample is called ABC,
if the ABC/GCB submodel has a value of 0, the sample is called unclassified DLBCL,
if the ABC/GCB submodel has a value of −1, the sample is called GCB; and
(f) providing treatment to the subject, wherein the treatment is (i) R-CHOP or ibrutinib if the classification of (e) is GCB DLBCL, (ii) ibrutinib if the classification of (e) is ABC DLBCL, (iii) CHOP, ibrutinib, immunotherapy, radioimmunotherapy, protoesome inhibitors, or mTor inhibitors if the classification of (e) is MCL, (iv) R-EPOCH, ibrutinib, CODOX-M/IVAC therapy, immunotherapy, bone marrow transplantation, stem cell transplantation, surgery, or radiotherapy if the classification of (e) is BL, or (v) R-CHOP, ibrutinib, high-dose chemotherapy, radiotherapy, or stem cell transplantation if the classification of (e) is PMBL.

2. The method of claim 1, wherein the gene expression product is isolated from a formalin-fixed and paraffin-embedded (FFPE) biopsy sample from the subject.

3. The method of claim 2, wherein the digital gene expression data is obtained using an assay comprising color-coded probes.

* * * * *